United States Patent 12,790,634 (MOST PROBABLE NUMBER ANALYSIS OF HETEROGENOUS POPULATIONS) - sequence listing, part 27

SEQ ID NO: 16 - DNA, 5630355 bp, unidentified (residues 3,753,571-5,630,355 of 5,630,355)
  source 1..5630355: mol_type = genomic DNA; note = Otoolea symbiosa
tattcccaccggttccggcaatgaccttgcaagaagtctcaggctcccgcgttccccacggaaatgcttaaaaaaggtacttcggccgaaatatcataaacttatggactacggtgttgtcacctatggagatgatgtggtaaaacaccgcagatttgccgtaagcgcaggcattggtctggatgccgccgtctgtcacaatctgctttattccagaatgagaccattgtttaaccggatccgcatgcagaagatgaattatattcttgtcggcctgaagcagtatctgaaggcgaaaccgacaaaggggtatatgctcctcgacggcagcaagaaagtagaatttaattatatttattttatatctgcgcatatccatccatttgaaggcagcggcttcaggtttgcgccgaaggcagactgcagcgacggcaagctggaggtttgtgcggtgagccatgcctcaaaactgcaggttttatttattttgggccgttcactgctgaaacgctcccataataaaggacttcgcacttatcagtgccgggaagttcagatccatacggacaggccgatggcagtccatgtggacggggagagctgcctgtaccagagtgacctgcatatacggtgcattgagcggaaagtcagaatcatagtataggaatgtgtgataatgtgtggcaggaggcgccggaaattttggcggaactgtcatagatattgcagatgcaacagataatataggacacagaagctgcgataacaaaatcagacacaatatgacagaaaggatacacattatgagaatcggacagggatatgatgtccatagactgacggaaggccgggatttaattctcggcggagtaaagattccatatgataaggggcttttagggcattcggatgccgatgtgcttgtgcatgccgtgatggacgcgctgctgggggcggctgcacttggagatatcggagaacattttcccgatacggatcctgcatacaaaggaatttccagtattgaactgctcaggcatgtgggaaagctgctggaggagaattgttatattatagagaatattgatgcgacaatcattgcccagaagccgaagcttaaggaataccggcctcagatggtagacaatattgccggggcattgggcattgaaaaaagccgtgtgaatgtcaaggctacaacggaagaaggtctgggctttaccggaaacggcgaaggaatttcatcgcaggcaataaccttgttgacgacagtagataattactgttatgatagggaaatgatgagaggggccggctgcggaggctgttccggctgttcggccaaccggctgacggaggaataagacaaaaccgcaaaagacagattcaaaccggaacctattaatataaggaataacaggagaaacataatatgaaaatttttaacactctgtccagaacaaaggaagaatttatcccattggaggaaggcaaggttaagatgtatgtatgcggccctaccgtatacaactttattcatatcggaaatgcaaggccgatgattgtatttgacacggtgagacgttattttgagtataagggatatgatgtaaattatgtatccaactttaccgatgttgatgataagattattaagaaggcgattgaagagggcgttgatgccgatactatttccaaacggtatattgaagagtgtaagaaagatatggcaatgatgaatgtgaagccggccaccacccatccgcttgcaacggaagaaatctgcggtatgcttgacatgattcaggatttgattgataagggccatgcttatacaggcaaagacggcaccgtatatttccgcaccaaatcatttaaggaatacgggaagctgtcccataagaacctggaagatttacagtcaggcttccgtgaaattaaagtgacgggtgaggaagacaaggaggatccgaccgactttgtcctctggaaaccgaaaaaagacggggaaccttactgggagtcaccatggtgcaacggtcgtcccggctggcatattgagtgctccgttatgtcgaagaaatatcttggggattccattgatatccacgccggcggagaagatctcgtatttcctcaccatgagaacgagattgcgcagagtgaggcatccaatggaaaaacctttgctaaatactggatgcacaatgcattcctgaatattgacaacagaaagatgtccaaatccctcggcaacttctttaccgtaagggagattagtgaaaaatatgaccttcaggtacttcggttctttatgctcagcgcacattacagaagcccgctcaatttcagcgcggagctgatggaggcatccaagaacggcctggagagaatcctcacggcggttgagaagttaaatgacgcgttaaaggcggcagaaggagagcttacagagagcgagaaagagaatattacttccgctaaggaatttgttcagaaatttgaagcttccatggacgacgatttcaacacggcagatgctatatccgctgtgtttgagctggtgaaattcagcaatacgacagcatcggaaaactcgtcaagggcttatctgtcctggctgaaagagaccatcgaaaagctctgcgatgtactcggaattatcacgaagaagaaagaagagattctggacagtgaaattgaggatatgatagcccagagacagcaggccagaaaagacaagaattttgcgcttgcagacgaaatccgcggaaagcttctggagatgggaattgtcctggaggatacaagagagggcgtcaaatggaaacgtgcctgaattgttttaaagaagcaatgaaactgaaagaagtagaggccagggaatattctcccctggccttggcatatctgggggatgccgtttatgagctggcaatccggacctttgtcatgaatcacggcaatacccaggtcaataagatgcataaaaagacagcaggacttgtgaaagcggaagcccaggccaatttctataaggttctggaggaagagctgaccgaagaggagaaggctgtttacaggagaggccgcaatgccaaatcggtgacgatggcaaagcatgcgacgatgaaagattacaggatggccaccgggtttgaggctctgatggggtatttgtacctgacggagcagatggagcggatggcggagcttttgggacacgggcttaagaagctgggagaattggaagaagatgcacaggagtgcatcggagcaggagaaaacacgtgagatttgaagaattgacaatagaaggccgcaatgcggtacttgaggcattccgttccggtaaaacgatagacaagctgtttgtactggacggctgccaggacggcccggtgaaaacaatcacaagagaggccagaaaacaggacacgatcattaattatgtggccaaagagagactggatcagttgtctgagacaggcaagcaccagggagtcattgcatttgccgccgcatacaagtatgcggaagtggaagatatattagaactggccagagaaaagggggagccgccgtttctttttatattggacggtatcgaagatccccacaatctgggggcaatcatccggaccgcgaatcaggcgggcgcacacggcgttattatcccgaagagacgggcagtgggacttacatctacagtggctaagacatcggctggggccatcaattatacaccggtcgcaaaggtgacaaatatttcagccactatcgaggagttaaaagaaaagggcttgtggtttgtctgcgcagatatgggcggtgagctgatgtaccgtatgaatctgaaagggccgattggtcttgtaataggcagtgagggtgatggagtcagccgccttgtgaaggagaaatgcgattatattgcctccattccgatgaaaggagatattgattccctgaatgcatctgtggcagccggagtcctggcatatgagattgtaaggcagagaatggaataaatcggacgaaagataatatgtgcagcaggtattttacagaagataagagatccggtatgcggacagagatacatccctgtgatgaagcagcggttttcgcatccggaagtgatggaagaacagaagcaagtatgatgtattgggggtttcgcgccctgaaagggaatgcggatagtcttgtttttaatgcgcgttcagagacggtgtcagacaaagtgatgttccgggaaagttttttacaccgccgctgtgttgtccctgccgccggattctatgaatggaacagggcgggagaaaaagccgtttttgagccggagaacaaagaaacactgtattttgccggtgtttaccggatggagaagggagtgccacggtttgtgatcctgacaactcaggcaaatgaatcgatggtaaaaatccatgacaggatgccgcttattattaaagaggaacagatagaagaatggctgggtggaatggagggctgcaaagcactgttgggacaggtgccggagaaactgaaaaaatccatggagtatgagcagcaggcatttgaatttaactgaagtggatgatgagtgcatttcgcgctatggctgtggacacaggaaattggaaaaagagagtaaaaagaaatagaagagcttgaaatctttcccgtctgtggtataattattcacatggggacatagctcagctgggagagcgctgcgttcgcaacgcagagaccgcgggttcgaatcccgttgtctccaggcatcattatctgcggcaaattattttgcagcttttttgatctctgagagataccttccatgaacgtgaaagactgtctgggaaggatgacactgtatttcatctgcgaaaaaataaaaataattgtaaaaaactgtcacatatttgattttagatcgtttattaagcgtagacttttccaggtctaaactttagtttctttcaatggggccaggcgcaatgcctggctccgaccctttcagagggagtctttaaaatctgagcaggaatctttccctgtcattcattatatgaaataaagagtaagaaaaatggtgtaggaaaagagtaagaaatattaaattggcggcaggcataggatgatgtacaatataattagtttcagtcctgagtcaaaaagagggaatactggtattgaatgacattacacttaaatagtgacgcgatgatgcttgttatttatgcgtacgccagccggaagtagttgaggatgtttctatgaataaaaaatttcgttcgtctcttgcaatgtggtttttttatgcggctgtaatcaccattactggtgtaagaactgcgatgacaaatgagctgagtggtccttttttagtgatttttgtcattgtgactcttttcgccctttatactttgattgcacttcttattaaaattttgaaaaaccgaggagattaatcttttcaattaatgaggtagtaaatactggtaccttaaatcgtttgtgtgcagggaaagcggcgggccgtttcggcgacatcatgcccctacatccgcagtatctggaatagggaagctaaaaaggactgacaggatatcaaaaagtttgcatgaaaatatgaatataatagctattaaaaggaaaagtgatggaaagagctgctatcatctggtggtggctcttttcgctatcaatactgatcgcttcagcgatgctacagaaatatccgttatatatcgagtttaagccatatcatattgctccacaatatagtttttcttttgaattttgtggtgtagacaatgatttatataaattgttatctgaggcatatatagaccaaatagcggatgcaagcgaattcaattagtaaatctttttaaagcaatacatataaaggcatttgacaatggtataatgcgaagtaagaacaaatcaaagttcccaatgtatcacgactaactcacttgtgacctgcgcttgtgaaacaagagtgtcaagcacccggtgcttatcgtcgaaagcaacggacttccagttccgcagacagccacttaggctctttgtcaatagttggggtgggagagaatgtgaaactttttctgtaaaattaactacgataaggtccttttatgataaaataaatatcattaggagggccttttactatggcaagacaaaagaaaccggttcacagagttgaaatgacagaaggaaaacgaaatattatccgacagcttctcgaggaatatgatattgagacagcagaagatattcaggatgctcttaaagatctcctgggtggtaccattaaggaaatgatggaggctgaaatggatgagcacctcggatatgaaaaatccgagcgttctgacaatgacgattatcgcaacgggtataagcgcaagcaggtcaacagtcgctacggttctatggcaatcgaagtaccgcaggatcggaaatctacctttgaaccacagattgtaaaaaagcgtcaaaaagatatttctgacattgaccagaagattatttccatgtatgcaaaaggaatgactacacgccaaatctcggaaacaatagaggatatctatgggttcgaaacatcagaaagttttatttctgatgtgaccgataaggtacttccgcagattgaagactggcagaatcggccattagacgaggtatatccaatcctttacatcgatgccatccactattctgtacgggataatggggtgatccgtaaacttgccgcttatgtcatactgggcattaattcggaaggcagaaaggaagtcctaacgattacaattggtgacaacgaaagtgcgaaatactggctttctgtcttgaatgaactgaaaaatcgtggtgttaaggatatcctgattatttgtgcagatggtcttactggtatcaaagaagcgatttctgcggcatttcccaaaacagaatatcagaggtgcatggtccatcaggtaagaaacaccttaaaatatgtccccgataaagacaggaaagcctttgctgctgatttaaaaacgatttatcaggctgctgatgaacagaaagctttggcagccttagagcgtgtaaccgaaaaatggacacctaaatatccgaattccatgaagcgctggaaagataactgggatgctatttccccgatttttaagttttcagctgctgtccggaaggtcatttacacgacgaatgcgatagaatcgctgaattccacctatcggaagctgaatcgccagagaagtgtatttccaagcgatacagctctgctaaaagcgctgtatctggctacttttgaagctacgaaaaaatggaccaccaccatccgggactgggcgcatgtctatggagaactgagtatcatgtatgaaggacggcttccagaataaagaaaaataagcggaaagacaggcggcttgccgcctgctcttgacatacatggaagtacctgttatatataaaacaagggtgaaaaacctgatttagaagtttcccacccttcattatcatagaagaatcttatttacagaaattttctcatactctcgggtgggatttgttaaaatcccgccccaattctatgaaaagggccctttttatgtttagttccaggttttactgattttgggcataccaaataagcctccgcattaccgacctttttatcttatgatgtacagtgaagtatccgggttcggaaccgtttgaaattccggattccgtagctgctccgttttaacacctttatcttgttgttaaatccttctgtgggaccatttgtcaatccgtatttaaaggcattcaggatttcttttcgccaggccctgtaggtcttagcacaggcctcaaattccttgatcccacagctctgtgcattcgcaatccagtcatcaaattctctctgctgctgacgatacgcttccatctggcagatatcatagaaccactctttcatgcggtgtgccagacgtagctcctcgctatagtgaagcattaaatcacaggccggtttgttctcatccttcagctttttgtagcgggtcagaatgagtttccggctgcgtttataatacttacgcagagaaaccggcatggaccgctgcagccgtttgcgtacattttcaatcgcccatgtcacctgccggatgaaatgatattatatgcagtaattacataaacaaaaataacaactcctataaagataactgcatcgcgtttagagcctttatcataacattcttttgcatgtgtcaatagtgtcaaccccataaagaaaaacataaaaggcatggaaatatcataaggtaacaatttcatcaggccaatagcaccaaaaataagcgttgaaatagaaaatatcgctttccaaattcgcatatatttcacctccatcatagataaaaattgctttttatcgattcgacaattgtatcatgataacccttcttcaatttacgtactgctctgcaattatggtttgcaaaacttcctcaataaattttgaagttttttaatatcgatgggcttggtaatgtagtcatccataccacatgctaaagccttatctacgtcctctttaaacgcgttggccgacataccaataattactgtgtggctatgcttagaattctttgattccaaatcacgtatcgcagctgtcgcatgatagccatccataacaggcatttgcacatccataaatataatatcatatttattggtatctgcccgaaagaattccagtgcttcgttaccatcactcgctacatctacatgtaatccgtaatcggtcaacagagtttgagctatctccgcattcagggtattatcctccactaacagtattcgcccggatgctttatcatgagcaattaatccgttctgctccatctgtgtatccggtgtaggcattaaggtattacgcatggtttcatacaagcgcgatttgaaaagtggttttgctaaaaatgccgtaatgccaacctcccgagcctcatcctcgatctctgtccagtcataggcgctgagaataataataggaagggtatcacctactttatttcgtatcctccgcgccgtctctataccgtccatatcaggcatctgccaatccagaataactgcattataatctaagtgtcgtttatgggcggactctacatagactacagcatctgccccattcaatacccattcactgtgcattccgatttctttcagcaaaagaaccgtgttttcacacacatccctgtcatcgtccactataagacatcgcagatccttaagcagatcagttgcaatacattccttctgctgttccttttgcatcggaagactgacagtaaatgtagtcccctcattcaaacgactggtgactgaaatactgccccccataagatccacaatacttttggtaatcgacattcctagtccggttccctctgttttgctaactgtggaagttgccgcccgctcaaagagttggaatataactttttgaaattcctcgctcataccaataccattgtcgctaaaacggaatacataaagagagtacccttcacggtcataaggggcctgctccatacgtaaactaatgctgtaagagattttcccaaaagtgaaagtagtatggatggcattgaactttccaattctgcaataaagattttggggatgatcaagcgcatgaattttcaaaatggggtaaaaagtgattatttattttatgataatgagcatgggagattaaagatatactttttcaataggacactcaggaaaatctgtaataagattgatattccgtttcgctcaatgcacaaactaaaaaaacgtatgctttggagtaataaataaaaatgatttattggctaatcaaaatattatgtaaaagtgtaacccaaagtgtaaccaaatgtaatcactaatttcatcgaaaaaaacgaaaaagtccttgaaaatcaaggactctaaataagctgctgacgggaatcggacccgtgacctccgcactaccaatgcgacgctctaccgactgagccacagcagcatctggttatttgaaccttgaatagtttatcacggtaacaggtttttgtcaactaccttgtggcaaaattctgcaagcaggtgcaggttatgtataaaatcaaccctgctgtctgccggttagccacagtcaaataaaacctgggcaggcagcaggagatgattccaaagaattctttaatttcctccaggtccgtcttttcttggacgttcggattccggaagcggttctgtgctgaccggaaattcatccggtacgtcgtatgtcgcattggaggttttcggcaaatctatttcgggaatattgccgtcatcatatacatttttcatcaggttcaccatcctttcctatagctttattagtatctgcggatacggaaaaactatgcaggtttcagttggggttaagttcttgtaatttcattaaaaacatgaattatagaaataataaaaacattataaaatataaaaacactcttcccttttttattattttatgatacaatatcaacatctgaaaaagtgatatacaggaacggggcattagcgcagctgggagcgcgtttgaatggcattcaaaaggtcacgggttcgaatcccgtatgctccattatagagttgaatttatatacgttaaaaaacattatttcgagagactgtattaacagtgtttggaaataatgtttttttatgtgggcatgaccttgtttcgggtagtcaaagtctccatctgcgcaacggtatggttttgggaaataaacagatttagacagaggaatccggcaggaatcaatcctgccggaggagtatgaaaaagtattactgcaggtcctgcctgctgattattatattacagaataaatgtgtcgaaagtttggaatctttgtgaaaaaaatgtgaagacctgttagagaaaacgtatgaaatctaattgacaaaacctgctgctctcttatataatagtattgctgtttttcggtgatagtatctgtgtgggagttcaccggagaacgataaaagcgggtgtggcggaatggcagacgcgctagacttaggatctagtgtccacgacgtgcaggttcaagtcctgtcacccgcactgaattataattctcagtgcagagtttaagcggcggtatcgtgaatgataccgccgcttttaatttatctgccccttttaacatcgtctacttctgattgactgtaggctgaaatgctgatataatgtacttgtacattaagcacaattgaagcgagggcagtggcttatggaaattattatcagtaataatgccaacaagccgatctatgagcagattacttcacagataaaggcgatgataatgagcggggaactggcggccggtgatgcgattccgtcaatgcgcgcattggcaaaagcaatccatgtcagcgtcattacggttcaaaaagcctatgaagatttgcaaagggacggttttatcgagacaacggttggcagaggaagttttgtatcggcacagaacaaggaattttatcaggaggagcagcagcgtatagcagaggaacatttacaggcggctgcagaaatcggacggacgagcaatatttcccttgaaaaactgacggagctgttggcaatgttttaccgggaggatgaatagcatggagaatatattagagctgcagcaggtatccaagacttatccaaagtcggattttattctggataatgtaactttttcattgccatacggggctgttttaggatttgtcggggagaatggagcgggcaagacaactacgattagctgcattctcaatacaattaaaaaggacagcgggacagtgaaaatattcggccgggaaatgctggactcagatacagatatgagagagcaaatcggcgtcgtctatgacggcgataattttccttcttactggaatgcaagacaattatccaaggtgatggagggactttatacgaagtgggatcattctttgtttcagaggtatttagaagtctttcatttaccggacgggcagaaaatcaaacattattccaggggaatgacgatgaagttagctgttgccgtggctttgtcgcaccatccccaattactgattctggatgaggccaccagcggtttagaccccattatgcgtgaggaaatgctggatgtatttttagagtttgtgcaggatgaaagccattcgattcttctgtcttcccatatcaccagtgatttggaaaagattgcggattatatcacatttattcataacggaaggctgattatgaccgcgtctaaaaatgaactggcatatgattttgctgttatgcgctgcaaagaaagccaatttctcacattggacccaggcgattttcttgcttacaggaaaagggattttcagattgatgtgcttgtagaaaacggaagaaaagcacagcaaaaatataaggatattgtgatggaccatgtctctgttgatgaaattatgcttttgctggtaaagggggatcgggtatgagggggcttcttataaataattattatgcggttcgtgccaatgcaaaagtcttttcaggctttatgctccttttgggactttttgcggctgccgtaatcagccaatcgcttctcatcggctacatatttctcgctgtgattggattttcagtcaatatgagttccagcctgcgcaaggagtttatctcaaagtggggaaaatataaattgacggcgccagtcaggcgggcggatattgtgaagagccattttatcagtcagttaatctggctgtttgtcggaatggcttttgcaggcgcggtggtggggctttcatggctgttacatggttttccctttgaccgaaatacggatattcttcttctgtttgccgcaggagttggaatcagtctcctgatggtagcaatctttttcccgcttttttatttgacaggggaagagcggagcgaagtggtattgggcatcagcctgcttgcggcaatcctgatttttatggggcttgtcagcctgatcaatctgtatttcggcccggaaccggcggtatggcaggtgattacaagtgcgctcattttacttttatgttcggcggcagcttttgcagtatcctatccgctggccgtcgtcatattcaggaagaaagaatattgatggaataccggaccggatgaatagacggcggacataataagaatctatgctggcagtgaaaacaaaaaggaggaaaaggagcatgtacgaactgattcaggcaggagaaaagacatattatattaattgcccggcgaaaatggggctttacagactgaatgacagcgaggtctgtctgatagacagcggcaacgataaggatgcggggaaaaaggttctgaaaatactggaggccggcggatggaagcttaagatggtgattaacacccattcccatgccgaccacatcggcggaaacagccttctggcgcagaggacaggctgttccgtctatacggccggtcctgatctggcatttacacagtatccggttctggaaccgtcttttttatatggcggttatccgtttaaggagcttcgcaacaaatttctgatggcccagccgagcggggcgcttcccctgaccccggaggtacttcctgaggggctggagatgatggctgtaaacggccactccttttccatgtcggctattaagacggacgacggcgtgtggtttctggcagactgtctgaccggagaaaatatccttgaaaagtatcatgtatcatttttgtatgatgtccaggagtatttaaacagccttgaaaagcttaaaacactggaagggaggctgtatattccggcccatgcggagccggttgaggatattaggcccctggctgaagcgaacaggaaaaagattctggaaattgccggcattataaaggagatttgcacaaagccccgcggctttgaggagatcctgaaagcggtgttcgaacactacgggcttgtaatggattataaccagtatgtgctggtgggaagtacggtacgttcctatctctcctggctgcatgacaggggagaggcggctgcggaaatagcggacaaccggcttgtgtggtgcagcgttaatgacgggacgagtgatggcggagcaatttaagtgcggaccgactccactgcgacgcttccgcctctcacaatttccattctgtttgtaaagcgatgttccagaagatgagccagctcatcattttcttcctctgtcctgacactttctaacaggacggaggaaggggagtatccggcaattttaacctgatatacgccggcaatcctgaatagctcagtcatatccgattcggtacagttttggatcttgataaacatgatttcttttctgtggatggcggcatcggtaaaatctaccaccttaatcacttcaacacaccgggccagttgtttttttacctgctcaaagatcatgtcatcgcctgtcaggctgatcgtcatgcgggatacggtcctatcctccgttcttccgaccgtgaggctgtccagattataggatttgccggaaaacaggccggagattcgtgccaggacaccgatatcattttctacaaacaggctgatccatcgttttttcatcatttatcccttcctcgtataataagtttgtaagcaagaaaaaccgcttacagacttattcttttttgggtataaatggtaaggatatctaagaggtactcccctcatcccgattcccatctatacagttgatagttacatttcaatataggtagatcctgtggtatgatatcaggtagagtctgatgtccgaaggcactgcttctcctcctttcagccggcttcgtccgagactgctttgaaagcattcagcctggcacatacggcacattccgctgacacagaattttcatccccagccgttagccccagcaaaaaaggctgactgggtgcatgctcattgcgcgagggttcggtcaccgtatgcggcacaggataaaccttttgcttcaggcttcacaaatccccatcggaatggaggtgatatcatgttaaagctcaactatatgtccaccttgtttgtaggtattgatgtaagctcaaagaccaatgccgtctatgccatggactttgaggaaaacaaatacatctcatcgtcgtttggcaataaccagccaggcgccgatcagcttgtaaatatgattgccgaatgcatgcagaagcataaaaacctggatacggttcttatcgtgctggaatctacttctgtatacagcgtgcatatttcaaacttcctgtcggccagcgaggttctcatgccctacaggccttacgtattctgtgtaaacccaaaggccacttcgaattaccgaaagtcctatatcggaatggaaaagaccgatcccacagatgcatatctcatcgcagactttggcagggtaggccgtacgaaaaaactggagccatggcgcggcgggcagttcatatccctgaaacgccttacaaggcaccgtatgcacctttctgagtgcatcaccagggagaagacttatatggtttcgaatctttatctgaagttcagtgaacttcagctccttgaaggtgatgacaagccttttggcagtctctatggtgccacgtcctcagctgtcctgacggaatttttgtctccgcaggagattatcgatatgccggaagaggatctgcttaccttccttgcggggaagagcaggaaccgcatctctgacctatcaaaaacttcggaactcctgcgcaaggcagccagggattcctaccggttagacaagtgcatgtatgaaccactgagcatatcactggcaagctcgtttaactgcatccacgcctatcagaaagaaatcaagctgatcgagcaggcgattgagaaatgcatcaacggaatgaaccctaacgccctgctcatccttcaatccatacctggaataggtccgatatgggcatccggaattctatcagaaataggcgatataaccgtgttccattcatccgatgcccttgccaaatatgccggcctttactggcctaagggtgattccggagatttcacttctgaggacaacaaaatgtcgaaagccggaaatccctatcttcgctgctatcttggcgaagcggcaaacagcgtcaggaagcacatccctgaatatgctgatttctatgccagaaaatatgctgaggtaaccaaacatcagcacaaaagagcactcgcgcttacatctcgtaaattagtacgactcgtttttggattgctggtcaaaaaccaactgtacaccggcgaaaagctggacaccgaatataatattgagtcgaactgacattcggttatacgtaaaatataccgaaggtctgttaaagttacccttttttctgaaaaacatatcaaaatcttcttcaaaaagttcttgacatatcaccagaatgctttctaatatcatatcgctgagccggtttcccggaggcacgatcggcaggacgttttcttcccggccaataataaattcaatgacggtaggaccttttttgttccgttttgcgctgagcagggctttgtcgatctcctcctcggcagttacccggatcccggcggcgccgtagcttccggccagctttataaaatccgggatatagtcaggacagttctcacccggggaattgcaggggaggggacagcttttgcggcgttggatacaggtggaggagtaatgccggtcaaagaacatttcctgccactgtcttacatttccaagatagccgttattgaaaatacagataatgacaggcagttcgtatgccacggctgtagccatttcctggacgttcatctggaagcctccgtcacctgatatgacgataacatccgtatccggatttccagcctttgcgccgattgcggcgggaaaaccgtagcccatggttccaagccctcccgacgtcagcatcttcctgccctccccaagctccagaaattgtgtggcccacaactggttttgtcctacatcggtggcaataattgcgcggtcaaaaatgcggttgatggattggatgatgcgctgaggtgtcaatccgggctgttctgctgcgagagggtgttcgcgtttccagccgtctatcgtcctgagccattcttcagtacacagcgggcaggctttttcaagaagggcgaggattgcctcttttgcatctgagacaatcgggacatccacggcaatattcctggaaatggaggcagaatcgatatcaatatggacaatggaggcattctttgcaaaatctccgatttttcctgtgatccggtcgttaaatcttgttccgatggaaaacaggaggtcacagctgctgacggcaaagttggcggcataacatccatgaattccgagatttccaacgtagaggggatgggaggaagggagggcgcctttacccatgatcgtcgtgactaccggaatatttgtcatctctgccagtcttgtcatctctcgttccgcacctgaaatgaggacgcctcctcccactaaaaagacgggcttctctgactggtttaacagtccgaccgccttttttatctggcccatatggacggaaacgttcggtttacagcccctgagttcgatctgctccggatagatgccgctgccgttttcctgttggatatccttgggaagatccacgaccaccacacctggtttacctgtatgagcgatgtagaaagcttttttgataatacttcccagttcttccctccgcctgacagtgaccgcgtatttacagatgctccttgtgatgcctacaatatcaacttcctggaatgcgtcgtttccgatgaggcccacgggcacctgaccggtgaagcataccagtgggacactgtcataattcgctgttgcaattccggtgacaagatttgtggcgcccgggccgctcgtcaccaggcacaccccggtcttttttgtggaacgggcatatccgtcggccgcatgaaccaagccctgttcatggcgcgggagaatgacatggatactcttttctccatacagtgcgtcaaataagtcgatagcctgtcctcccggataagcgaaaatggtgtcaacgtgttccgcttttaatgctttaacaaataattcggctcctgatatcatgatagctacctccttcaatatttagaatgcatgcacttgcttgcataacgggtcagattatggcactgccgtccggcagtgcctgttctgtcaatggcccctgaaaagcctgccggttctgtattttttcaccggacaggtacaaaatgtttattttatctgcggtattccgccgacaaaggtttccacactttttctgacaaaatccctgcgctccgctttggtcagattctctccgaaggaggccttcagaaatgtaaagccgaaagttgcggagaagattgtcattgcaagacattcaaaatcctgtcggggaagtttgccgcgatgttccatctcctcgagatagccggtcagggaggagagaaaggcctgggggattttcataatcagcggagccgtttcctcgtataactggggcgctctcagccctatggacaggttgacgaaatcgggggtgattttctccatgtaggtgttcatgaacatttccaaatccggctgtaattcccacactacattggtaaatacctccggtgtcagattcccgagccatttttcctgctccattccgctgagggcaatctcttttttgctcttgaactttctgaaaagagtacattcattgacttcggcggccctggcaatatcttttgtggtagttgcgacatatcctttatctctgattaatcccattgtcgcatctatgattttttggcttgtagcatccatctattcacctcgtgcaagtgttcactttcatatgattttacaggctgggtttcaaaaagtcaatctttttatattttccgggtgcaaaaaagttgcagttcagccttcgtccgaactgcaacaaacgatcctgcacgctccgcgcacaggtcaccgtcatcaattatgcacagaaacggcaaaaaacgcctagcggaatacatcatggctgaactgttacgcaaaaaagccggatatgaatcatccggcttttttctgtagagaactgtcacaccgtaaaacggtatggttaaaatttctggaaatcttcaacattcataacaaagattgtggaaccgcccaccttcatattcatcggaaccgtcatattgacagttgggcagcagttcccggccatggttggtggtgtgtaaaccagttgttctcttgttcctgacatctttttgataatggtaatcgcttcctcaacacggctgtcgtcaacgcccagcatcagagtcgtacttttcttctttaaaaaaccgcccatggtggaaagtttagtaacaaagaaagaattctggtttaattcgtaaactaaatcatccgcatcctcgcttccgataattgccataatcatcttcatattcagcacctcctaactcactattgtaactattttaccattaaatcgagaaaatgggaataaaaagttcattaaaatttatttttccaaaataattttgctatttcactgaatatacggccgggaaaataccggaaaagtgccggaaaataaggctttgcggctggtcttcgggttgactgcggaaaaggagtcccgggcaaggaaaaggccatgtccgtataaattttacaatagtccgccatataaatacatgaaatagctgcaggttatagctggaataactatttcgtatatctgggtgacctccggaaaatggacatttctgtataaatctgctattatagcagacgtgcgtctgcgtttcgggtgtttgtcccagaaatacaaacacttgggaacaaccgcatttacagatgcttaacaaattatattcagggggaattatcatgaatcagagaagaggccagtgggccagcaatatgggatttattctggcggcggcaggatctgccgttggtctgggcaatatctggaagtttccgggaaagaccggagcatatggcggcggggcatttttactgtcttatattgtgattgtggccttggtaggctttccggttatgctggctgaactttccatcggaagagctacacaaaaaaacgttgtaggggcgtttcaccagctcaataaaaaatggacgtttgcaggcggtatcggtgtattgacactctttgtcattatgtcctattatagtgtggtaggaggatgggttcttaaatatatttttgcctacctggccgagccggggtttggcaacggaaccgtgtcttaccaggaatattttgtaaactttatctcggaaccggtacagccgcttgcatggggtttcgtatttctggttctttgtatctatgttgttgtgaagggcgtttctgagggtatcgagagggtcagcaagattctgatgccggctttgttcatcctgttagttgcctgcgcggtacgggcggtgacgcttccgggtgcaggagaggggctttcctacatgctcacaattaaaccgggaagctttaatcgggatacgttagtaggagcgcttggacaggcatttttctccctctccgtcggaatgggaatcatggtgacttatggctcctatgtaccgaaaaaagacaatcttgtaaagagcgcggcctgcatctgcgttctggatacgctggtggcatttctggcggcttttgcaattattccggttgtgtttgttaccttgggagccgaaggccttggtatgggcggaggctttgcttttatggccctgcctgaggtatttgacgggcttccgggaggaaggatcttcggactgttctttttcgtgctcctgtttttggcggcgctcaccagcgcaatcagtattctggaaagctgtgttgccttcattacggaggaatggaaggtttccaggctgaaggcgactgtgattttgtcggttccgatggcgtttctcagcgcgggatattccctttcccagctggagtcgaggaatatcaacctgccctggttcgacttttcgaaaggaatccagatgctgccgatgaatgcggtgatggagaagttcactgataatctgatgattcccgtgggttcactctgtttctgtatttttgcaggctggatttggggaaaagggaaggcgtcggaggaaatcagctccgggggccggtacccgttccgtctcagaagggcctgggagtttatcgtgcgttttgtcgcgcctgccgttatcgtgctgattttgtattttactgttggaaagggccagggcctttcataattcaaatattgcagcgacagcgcctgctgccggtctttaggaggaaagaatgattaaaaacattgtatttgatatgggacgcgtcctgctggactatgatgcggtcagggtctgctggcagtatacggacagcagcgaggatgtggagctgatgagcagggaactgttttttgccgaagaatgggtgcttctggatcggggaaccatcacggaggaagaggcattaagacgcgtgcagaagagactgccggacgagagaacgagggagatggcccgattatgtctggcccactggcatgagtttaatatagaaccgaagccgggaatgagggagcttgtaatgcagataaaagaagccggatgtgccgtctatctctgttccaatgcgtcccacagactgcgtgtgtttgaaaaggaaatacccggcatcgaatattttgacggagttcttgtctcggcggaagagaagatgctgaaaccggagccggagatattccggcgtttgtttgagaagttctcgatacttccggaggaatcattttttatcgacgatatacaggctaatattgacggggcagcggcctgcggcatgaaaggatactgctttgcggacggagatgtggaaaaactcagggaatacctgttttcacaggtgataaataagcaggtgaggacgagccctcctcccgtcaattaaattccaatatcttagcccccagagctccggcatcgttccggtcatgggtggacatcaggacaggacgtccgtctgttttctcaagaagatagcggatgaccctgtcctttgtcttttcatccaggccggtaaacggctcatcgaaaatgaacatatcacagggagccagcagggcgcgcagcagggcgcagcgccgcttcatccctccgcttaaagtagagaccgggcggatgatcgcttcctcggggagaagtcttgcaagctccctgaaaagcgacggcctgtcgggacggcccggcagggccagggccacattctccagcggggaaaactccgggatcagcctgtcttcctgaaatacggcggaaaaccggatttgttccggcgcagggcagattgtgccggaatccggtttctccaggcccataatcagacggaacaaggtggtttttccggttccggacggggccatcaggcagcagatatccggggatgcaattttcatgctgacgcctgagaggaccggcagggagccatatgatttataaatattgttgagtatcagttccatgataacctccgtatcaattctgcatattttccttttttgtccgcctgcatcctgtcccggcgtgattttttttaccgagggagcctaggaaaaacagaaaaagattttcaattaaaaatgtgactgcgatgattaccagggtccacgaaaaaaggccggccgtgtcgagataaatcttagccatataaagctgctccccgatggagtggctgggaactccgattacctctgcggctactccggatttaaagctcatcccgagagccgtcctgacgctggtcatcaggtagggcagtaatgcaggaaaatagaccgcttttactttccgcgggaaggagaagcggaatacgaatgccatctccagcaatttttcatcagtgcttttgaggcctgacaaagttgcggtatagctcatcgggagtacaattgtaaacgcgataaataccgacaggttctccgagccggtccagattaaagccaggataacaaaggaggctacggggatggatttggcaagcagcattaccggggccagaagctcatccaggaaggaaaaacggaaagccaggcagccggtcatgattccgcagaaaaaagcgctcagaaatccaatgaagatgcggaatgaagacaggccgatggttttccagaattccggcgtggtaatttgtgccgccagtgaagccagaacatcggccggccccacaaatataattgagttattgatggaggaagacagaatctgccacaaaatcagccagaacagaaaaatcccggtcttttttaatagattgccgttattatgtttttcagccgtatttaaatgcttcagattattcatattcctgtctccggatcgaggtcatatgccccgtagttgttatttgtaacggttcatttgtttaaacggttaccgttatgttacttttcacacctttgccaaaaagcggcaatgctgtgaaaaataacacgcttcgcgatgcgcagaaacggaaaaaacgtcgtttcgcgccgtgaaactcgggattttcgtgcaaaatacgcacgaaaacacctcgcgggacattaccgtgtgaaaagtaacactgctatttctcgatataataaaaattgtcggccggcagttttccgccgacggatttcggatcctgttcaaataagacattcagataaccggacagagccgctttcatttcctcaccttcgataaaagtaatgttacagtaggggagcgctttctgggctatcggggccttctcgataatccctgcctgtacaatctgttcggctgtcgtcttgggatcggagacagcggcttttgcggaaactttgtggtctgagaggaagactttcacggcttcttcattatttttcaggaattcattagtgacgatggtaacaccggttacaaggcggctgccttctgctccctgtaccttatcccactcggcagtcagatccagtacgattttcagcgtctcgttctgggcgcaggccacagtcacaaagggctgcggaagaagtccgatggaatccggcttctccttaaggattgcagccacctcggcagcttcggatttatattccagttttacgtcctgttccgataagccatttgcttttaacaggtattgaatcacataatcgggggttgtacccttgcctgtcagatagactgtcctgccttttaaatcagcgactgatttgatggaatcatcggcagagacaatgtagagtacacccagggtgttaatgtcgatgacggagattcctccttccgtcttgttatacagcacgcttgccacgttcgcagggaccagggcgatatccagtttgccggaggcaatggaagcgaccagctcgtcggcggcagtcaccatccggaagtcatactggttggcggaagtatcggagttcatcagggaaacaaggcccatggatgtcggccctttcagggaacctacacggacagcgccttcggagttattctcagcgccgtctgaagcgttttcggaagaaacgtcttcggaagctgtttcctcagcagacgccgaagcgtcagcgctttccgatgattcggcctgtacggacggtgcgctgccggcagccgaagtctctgcggtcttgctgccggatgcacagccagtaagggatacggcggtcatggcgaatgccatgagaatgggtaataattttttcataattgtctcaatcctctctttttgtggtattgaaaagcagtgatatcgcagcccacaccgaggaaacggatgagaaacagccggtaatgagtaccggaaattacagcactctgaaagagggtgccataaactcatgcttcctcctcagcataggaagccaatcccttgacagacggccggatgcttcagagtgagcgcgaactaaccttactatacaggatcggccggaaaaaaacaagaggcgtccggtgcaaataaaaagttaaaaattgactgaaatctatgcggatttactgtgttttatgtgaaaatataccattagaatttccgtacgtcaccccttataatatcggcataaaggccgcttgtacagacgactgtaaaataagtttgaaatggaatcaggaggaaaattatgaaaaaatggagcagtatgatgggagccgtgcttgcggcggcaatggcagcgtctctgacggcctgcagcggcatggaaacagaggcggggcaggagataaagggagcgccgggatttgaggggcttgagccggttgagctgattggagccgacgccaatgatttctttgatgaagtcctggctcttgacagtgtaaagcagctttatcaggatatcgatcagtcggtggacggactcggaaccatcctgctgtagagcctggaaacggcggcaaaataaatcagacgggaaaaattacagaaaagggagtattgtcaaatggccgattagatatcggatcatggcaataccccttttttgtctcatatgaaaatcttccaatcagataaaagccctcctggccggattgtaaagaaaatgttaaatgtattggaaatctgtataaaatcgtggaaaacccagggaatgccttaaaaaaaatacaagaaaacataacgcaaaggattgataataatatcacaatatgagataataagtacagccggaaggcggcagaaaacgactttgttctcactgctggggaaggggtcacgcgcagccgacggaagagaatcaaaaagggtgaaagccctggtaataaatagttgctgaacacaaaactgcgctttatgcagggctgtgaaccgtaacagtaaatagaatggatgagaagaattcagggaggtttaagtaatgagagtatcgatctgtattggcagtgcctgtcatctgaaaggctccagagaagtgattaagaagcttcagcagcttgtcacagacaacaagctggacggcaaggtggatttaaacggagatttctgttccggcaattgcctgaagggagtctgcgtaacggtggacggggaactgtattccgtaaagccggaaacgacggaagaattctttgaaaaagagattttaggacggcttaaacaataacctgcatgccccgcgcacaggtcaccgccatcaataagagggagaatgcgatgccgataatagatttcaaagccgcgatgtgcaagcattgttataagtgcgtccgcgactgtgaagtaaaatcgatcatgattcgtgacggccacgcttatattatgccgaaccgctgcattctgtgcggccagtgcctgattagctgcccgcagtctgcaaaaaagatgtccagcgagctggaaaaagtaaaatcatttataaaagagggcaggccggttatcctgtcactttcctcggcttatatcgggctgtttcaatataaaacgagggggcaggtgaaagatgcccttttgaagctgggtttcacggatgtacgtgatacggcggaagcggctgcgatggcgaccggcgagtatgtgaagcttttggaaaagggcgatatgaagaacatcatcaccacggcctgtccgagcatcgtgagtctgatagagattcattatccggaactcattgactatctggctccggtgctgatcccttccggaatccatgccaggatgctgggggaggagtacggggaggaggcgagaattgtcttcgccgggccctgtatcgccgagaaagagaaaatgagggcggtcagccccgacgcggtcctgacgtttgaagagctgaagggatggcttgaggaagaagaaattaaaatagacgaatgcgaagacgcggattttgacgagcgccatctcggcgcgaacctgcggtatccggtcagcggagggctgctgacttcggtggagacgacaaagacaaagccggacaggtaccgtaaattttatgtcagcggcgtcaaggactgcctggacgtctgtgaggctatgatgaccggcgaagtgaagggctgttttattgagatgaacgcctgccacggaggctgcatcaacggccctgctaccgcggctacggtatccagttttaaggttaagctggatttggaggcgacgcttcccagagaacctgcggagctgtcggctctgagcgagaaggccagggctgtttccatcggccgtacctttaaaaaccgtgcccggaaagagattatgcctacggaggaagagatccgtgagattttaataaaaacgggcaaaaccaggccggaacaggaattaaactgcggagcctgcggctatccgacctgccgcgaaaaagcgattgccgtctgccagaagaaggcggagcttaatatgtgcatcccctacctttttgacagggcaagatcgatgtcccatctggttatggagacctcgccgaatatcattatggtgattgacgaagatttgaagatcctggaatgctccgcggccacggaaaaatattttggtataaaacgcaaggagatgaagggacgcctgctgggagaattcatcgatacggaagatgtaaaagaggtattcaggacgcataccaatatccacagcagaaaagtgctttatccggacctgaagcttgccaccctgcagaatattgcctatatttccaaaggtaatctggtaatcgccacgcttatcgatgtgacgagggaggagaagctggaacagcaggagtatgaaaagagaaaagccacaattgaacttgcccagaaagtaatttttaagcagatgatggtggcccaggaaatagcggggcttctgggagagacaacagcagaaacaaaaacgacacttacaaaactttgttctttgattgatgacgggaacgaaagtgaggtccgataatgggaattaccgtagatgtcacttataagagtctgaataaatattccgaaatcctctgcggagatacggtggagcttttaaaaacggaggattccgatgtaatgatcctggcggacggaatggggagcggggtaaaagccaacatcctctccaccctgactgccaaaattctcggtacgatgtttttaaacggcgccactttggaagagtgcgtcgaaaccatcatgcagacgctgcccatctgtcagatccggcaggtggcctacgccacattttccatcctccaggtatttaataacggagaggcttacctggtggaatatgataatccccgctgtatttttatccgggacggggaagtaatcaagatccccaggaacacaagggtagttcaggataaagagattaatgagttccgttttaccgtaaaaaagggagatgcgctgattcttcttagcgacggcacgatccacgccggtgtgggcaaatccatgacctttggatggccctggaaggatattgcggaatttgtggtaagacaaagggagcatgccatctcttcgattcgtctcgcggcggctgtctgcgaagaatgcgataagctctatgagggaaaaccgggagatgacacgacggtagccgtgatgcagattattgacagaagaccggtgcatctgatgacggggccacccgtggaccgggatgacgatgagaggattatctcggagtttatgaaagatgagacggcttcccgcatcgtctccggaggaaccagtgcaacgattctttctagagagctgggaaggccgctgaaggtttcaatggattatacggacccggagatcccgcccatcgcttatatggatggaattgagctggtaacggagggagtcctgactctcagccgtgttgttgacatactgaaccggtttgtagaaaaaaaagatttgagctacgactttttcaaagagctggacaaaaataacggagcgtccatgcttgcgaaaattctgatagaggactgtacggagctgaacctgtatgtggggaaagccattaacagcgcttaccagaatccgggactcccctttgatctgggaatccggcagaatctggtgaggcagcttaagacggcagtcgaaaaaatgggaaaacgagttacggttacgtactattagggcgggatactacctgtgaacagtaacaggagcggtaacatcccgcggaataaacctacttaacagttacaaggaggatatataaaatggtaacaaatgacgcaacaatactgaagttaaagcatgatgtactttacgaggtagcgaagctggcatgggaggatcagctggtggatgataaaagggacgaacttccgggcaaaatgattcccggaccgcaggcccattaccgctgctgtatttataaagagagagaagtaatcagacagagggtccgtcttgcggaaggcaagtgccctacgggaagaaacacgaataatgtggtccaggttatcaatgcggcctgtgaggagtgcccgattgcctcctatacggttacggacaactgccgtaaatgtatgggcaaggcgtgccagagctcctgtcccttcggagccattacgatgggcaataataaggcgtttatcgacccggacaaatgccgtgagtgcggtaaatgtgcgacagcctgcccgtacaatgccatcgctcatctggaacgaccctgtaaaaaggtgtgtccggtggacgccatcacttacgacgagtacggtatctgcgtgatagacgagaagaaatgcatccagtgcggtgcgtgtatccacagctgtccgtttggagcaatcggttccaagaccttcatggtagatgtaatccgcctgattaatgcgggaaagaaagtagtagccatgctggccccggccacagaaggccagttcgggccagatattacctttgacagctggagaaccgccctcaagaaggttgggtttgccgatatggtggaggttggcctgggcggagatatgacggcggccgcggaggctgaggagtgggcggaggcctataaagagggtaagaagatgaccacttcctgctgtccggcattcgtcaatatgattaaacagcattatccggagctgatcgacaatatgtccaccaccgtatccccgatgtgcggcgtctcaagaatgctgaaagcggaggatcctgagatcgtcaccgtattcatcggcccgtgtattgccaagaagagtgagactttggatctgaatatccagggaaatgccgactatgcaatgacctacggtgaaatacgcgccatgctccgcgccaaaggcgtagttctggagccggaggagaataaaaaccagcaggccagcgtatttggaaagcgctttgccaacggcggaggcgtaacggccgctgttctggaatgcctgaaagagacgaatgaaaatgccgatatcaaggtggtgaaatgtaatggagccgcagagtgcaagaaagcgctgctgcttctgaagatgggcagacttccggaggacttcgtggagggtatggcctgcgtcggaggctgtgtcggcggcccgagcagccataagagtgagatggaagcgaagaaatcaagggataagctgattgccgaggccgatgccagacaggtgcatgagaatctgaaacagtataagatggattccttctcaatgcacagacattaatcgcagccggatttggatatggaacacggcgcctgcggtacctggcgcggacggctgagaaagaaaagaacagatagggaaagaaaaataaaggagcgcctgtcgtggtttagccaatcacgacaggcgctttttgcgtcggataaagcatggaaaacaaagccttctctttttacttgacacatactataaattacagtattatgggtaatgacactgacaatactataaaatatagtgatatatactatagtatataattcgaatgaaagaaaggagtgttatcatgaatgagggtaacagaagaatggagcttctggggagtgcgcctatccccaaagctcttttagcaatggggctgcctgccatgattggaatgatgatcaatgcattatacaatctggtggacgcctattttgtcggaggtctgggaaccagccagatgggggcaatctctgtggcatttccgcttgggcagatagtggcaggactgggactgctgttcgggaacggcgcggcctcctatatttccaggctgctgggctatggtgaaaaagaaactgcgaacaaggctgcaagcacagcgctgtacggcagtctgcttgccggtgcggtaatgattgtctgcgccctgctttttctggagccggttttgatacttctgggcgcgacggagagcatattgccctatgctttggcctatgcgggaatttatacggcctcatccatattcaatgtctttaatgtcacaatgaacagtattgtgacaagcgagggagcggccagaaccacgatgtgtgcgttgatggcaggcgcggtactgaatatagtcctggatccggtatttatctatgttctgggactgggggttacaggagcggcaaccgccaccgcaatttcccaagcggtgtctgcgcttgtgtatttacgttacgtattacggagagaaagtgtctttaccttccgtgttcaagactgctgttttactgggaaaatcatatcggaaattatgaaagtcggcattcccaccctggtattccagcttctgacaggtctgtccataacactcatcaatttgcaggctaaagaatatggtgattcagtcattgccggactgggagccgtaacaagaatcaccgctatgggcagtctgatggtatttggatttatcaaaggatttcagccaattgccggatttaattacggcgctgaaaaatatgacaggctgtgtgaagcggtcagaaccgcgattatatggtcgaccgtattctgcgcggcctatggactgaccttagccctgttttcaacagccattatatcaggcttcacgaaaggagacggggaaatgatccgcgccggccggaaagccctggcggcaaacggctgtactttcctgctctttggcttttataccgtctattcctccctttttcttgcgcttggcaaagcaagggaaggctttatcctgggagcgtgcagacagggaatctgctttgtgccagtgatttggcttctgccgtcatttatcgggatggatgggattcttttcgcccagcctgtttccgacgttatctctgccgctgttgccgttattatggcggtccgcctgcacagagagcttgcccatattaaaattccttgttcttgtagatccgcagcgagataaaataggaaatcaacaaaagcagcggtgaaacagataaagctgccgctccgacaaggccggatcgcaggttaatccctgcggtccacggagcgagtaatactgcgacaatcagcatgaaaatcccggcaaaaaaggcggatatcaggattatcaattcatttttttctgtgccgattttcagcatgacaggaaacattatcgcggccactgtaatggattgtgtcagaccgtactgatacccccaaatcaacgaagttgtgttcaatgacggtacagttacaaccgtcatcagaccggtaaggaggctgacggcaaatccgaaaaatatcaggatacagaatgaaatatattttgccagaatcactgatttaacgttcaccggcagcgtcagttcaaagcggttccagtttgagatttcatcggcctggagcgacgtgcccacattagcgataaagataaatatctgaacggccgtaatcatggataaaacaacgggttccctgtttatcagcggagtcaatattaaaaagccggccatcaaaaaagcgagtttgatattattttccattgagtaaaacgtattcctgataagccctttcatctatgtctctcctttcacataaagcagcattatttcgtctattgttacagggacgatcatggctttggggtactttttctcggctttctttctgtcaccgaccagaatctgccattcatagtcccttttccggtaagcgataatatcctgcttttcaatctggccaaattgtgccaggccgcattttataattccatagtctgcgagtaattcatcctttgatttaaaaaagacgagttttccggcatgaataaaaataatatagtcggctattttttccagatcgcttgtaatgtgggaggagagcagaatggagttttcttcctcctggacaaaagttaaaaataaatccaggatgtcgtcccttgtaaccgggtcaagtccgcttgtggcctcgtctaatattaaaagccggggatgatgggaaacggcggcaataatggacagcttcatcttcatgcctctggaaaaggtcttgattttcttatcacgcggtaaattcattttctcgagaagcgaaaaatacagagcttcatcccatgtatgataaatatcttttaaaaccttatgaagcattttcggtgaaagctccccggaaaaattgctgttgtcaaacactacgccaatcagtttacggtcagcggccgtcatctcgtaatcatgcctgcctaatatcgatatatcaccggaatccttttttataagccccaacaccgcattgatggttgtactcttaccggcgccgttttcaccgactaatcctacgattgtgccctttggaacctgaaaggaaatgttctgtaaagtaaagctgctgtaggttttacttaatcctttgacagttaaagcatccatggtcagtcctcctcgtataaaagcgttaaaagtctcgttaatttatccagcttgataccgctgcaacgggcgatttcgatggcttcggaaaagtgttcctcgattttcttctgctgttcttccagataaaagtcttgattctgtgccgaaacaaaacagccttttccggccgttgtctcaataaatccgtctgtctggagagaatcgtatgctttctgtactgtcagaacgctgatatgaagcgattttgccattgaacggattgacggaatggcatctcccggttttagttccccgtttatgattaaggcttttatctgatcggaaatctgttcatagatgggtttgcttgcatgattattaataaatagttccacaaaaaacctccgctgtactatactgtattactattacaagtacactataatgcatatagagaacagtgtcaatagaaaaattaagcaggcgaggatgccgccggtacggccagtggacggggcggtgaggtggtttcatgagtctttcgtcccggggaagattgtcgtgggttggagctgcgcagactatatattcccctccgccccaaggataggttttctccgggacgaaagattcagccactcccctcaccacaccggacatggcccgttccggacgcgtccttccaatctcattaaatctaaaaacagatcttgcaaaagagaaggatttgtgttagattaaaatcatcctcaaatcggaggagacttacagatatcaatttcgttatcggttttattcttttatctgttctaaggcgggccaaggccttccatgaatcaatcggtgccgaatttccggcagtatttcatttaatattccattttgcaatttattataatctttttgcttttgtgcttaatttgtactattttttttcatattctgaatttctgtttgttagtcatgcttagtatctaaatccgctacatctaaacccgaatccgcagagtttcaaaacattagtaacagttcagactgcatgaactgttactaatattaatcatgccgtatcataccagtgtgattttgtttgccaaaaaaaaaaaacaggagaccagctatgaaaagtcaagtataaattaggcgaaaattcatttttctaatcgatggtaaagaagggtaactctaataaagctccctaacggtgctttttcaaaatctatcgatattggtatgcagacctcttattcgaggttaaattccacttcgtcagtgagcatcttccatatgaccctgacaagtttgccggcacagtgcccaagggcattatagtgagtccggccttcggctctcttggcatcgtagtaagctttgaaagtcgcattgttctttacgacattatgtgctgcatttacgagagcgtaacgaagaacacgcgagcctcgtttggacatccgggtcttcttggcctggaagttaccagactgataaacagacggatccaatccggcaaatgcaagcaatttgcccggtgtagggaagcgatggatatcgccaatctcaccaagtatcatcccgccattggtagtcccaatgcccgggatggtcatgatcacagagtggaggcaggtgacaaggtttgctatttcaagctctgtatggaataactggctatccaataactcaatctgttcaatggtctgagttatttgaatagataaggaactgtcatggataccgacagacttctgtgcgagaattcttaatcctctggccgtatctttaccaaaatgaccgtgggaagccgtttggagaagatgagtgagatgagtcatatgcatagaagcaatatcattcggtgtcggcgcttctttaaggagcgtatagacagaattctgatgcacaccggacttaaagaagtgctgtagttccgggaagacctgatccatgtaggaagtcagctgtatttttaaacgggtgcgctgcttcacggttttctgtcggaatctgccgagttccttgagttcgatgtaatccagatcctttaaggagatgaaccttaaaggatcctgcaacataagggttttagcaataacaaatgtgtcgactttgtcggtcttcgtcttgcgtacattatttttacgcatagccgaagtcgataagggattgagaacacacactttaaaatccttgcttatcaaaaaacggacaaggttgtcaccgtagtgtgccgttgattcaagaccaatgatgatgctgtcctggtcaagtggtgccagtttagaaagcagcagatagaagccatcatagtcatttgagaatttgaacggctcgatgagtatcccgccctccgaagaaatggcagcggcgaaatggttgagtttggcaatatcaatgcctacgtaaatcatgaggttgtacctccctttcataaagtccgataccgtgatatccaccaacgattatcatcgtagacttgattgaaataagtactcagagtgaaacactccggcaacatccagctataaacaattcagataaaagtagcggcaatacactcctgttgagtagtcaagctacaggataaaatcaaaagtccacagtatctgaatgtattaaaccacagttcaagaaaaatgaaaggaatatgttgtttttgcttctataaacatcatacaaggaaattatgacaaaacctaaaacaatgaaatggaaaaaaggaagattagggaagtcaaaggagggaagtcgtgaagcgttttaatacaggacttttacttgccgccgccgtgctgataatctgccacggcttcccttcctatggcaaagaagaaaaggagggatttattgaatatacggtatcttttgtagatgccgcagaccatgataacaggatttttaattcgcagcaggggcaggctccggaaggaactgcaatccatgtttcttttccgaagcagattattggggccgacggacatatctggagggcggaggcagacagtccccaggaatttctcctctatcaggcaggccgccataagtactacgtcgaataccggcagggtgagaagatagcggcgccggaagatccggatcgggaaggccgggaaaggctcgcccggtggctcgagcgggcgtggaaggcagactgccttattacgggacagggagaggaggaaggcagcggcgttcatttgatggtagagaatgaatcacgcaataacgaacggattaaaaatcttgtttccatgattcaggatgcccggtggcacagtttttatatgattggaaaaaattacgtgccgcagacgctggtaatcggcacaagctttgatgcagagtattctgccgtcatggaagacagatttaaggttgggaaggatagctgcaccgtactccggatttccgttcgccgtaactggaatgcggaaaactgtacccataactgggagcttatcattgcaggggagaatgactgtctgaaaaatggacaggagacctactgctgtaagaaatgcagaacggaggagacagtaatcctccccgcatcaggccattatgattcggacggagattctctctgtgaccgctgcaaaaaacgggcgttccccgcacagattggagacagaatcagaactgtcctccaaacggagagtggagaaaaagagcttgtcttccgctgtcttgatttgaattacagagggtccggaaacatgctctatctgtcggaggaaacgctgggggaggatattacgggcatttgttttacggagtctgactataacggttcgcctctccgggaatattttaatctcgcatttgccaacaacatttctgccgcgtctgccctccagccgattgatcggccggacgcagacggaaggaacgattatgcggcactgctttcaacggatgagtatgaagcgtatgcagaaatgatagaagcagggaatgcctgccttcttcggactgtgtcaggaggcgctgtttacgccgtggatccggagggaggtctgtgccttgttccggcagcggaaagcagggcgtatggtgtccgcccgttcatattgttgaaaagtccggagacaggggagaaagctgagctgtcaaactggaaaacgggggatatccagatgcggcagatagggcagaagctgtaccgtttccgctgtgtggatgaagattacagtgataatctggatggccgccgaagcgccgccctgtttctctgtgacagtgtgatccgtgccgatacctgcagcagcatggcattaaaagagatttctttcgggcctgataataattataagtcctcccggatacgggaatggctggcgcaaaacagcgtgaacagcagctttaatttagaaccggttttgattggaattaatacggcctatacaggggggacggcggcaggaaccatggagcagctggacggcagcctgctggcgccgcatgatatcggttttcagttgatgcaggatcgtttgttctgcctttctgtggaggaagcgctccggtacaggaaggaactgtggcggttcggttcacagcagaataatccggcagttcagataagcccctattcacagggatattatcttcggacgccctattacgcagaggatcatgaagggagattttattactccgatcatgtatacgccgtcgatttagtcaacggaaatattcatccggtaccggcagggagccagacatacggactccgtcccgcctttgcggtgccgcaggcagaatagggagtaccgtgtttctattcgcagaaccgtaatatatagagacagcggggacgagaaatcaaggaagacaacaagggcggctcttaaaaaaagctcttttgagaatgaaagcgaggaggatacgatgaagaaaagaaatcagggcatactcaggcaggggaaagggctgacatcggcagtcctgataaccatcatgcttttaaccggttctctccatgggttggcagcgacaaatgggtttacctttgaggactgggataccgtgtacagccgggaatttgatggaaggcgcaaggagaaccgcatgacaactccgggagaggcagagccggaaaggctagcagcggcatccggaagtgagatccctgcaacaagttccatggcgctgtcggcggtgggaaaaagttcgctgggagatatctgggataactggaacggggatttttcatttttagacggaacagccggggacggttcggaaaaaaaaccgtatcagattaaaaataaaaatcagctaatgggccttgcccagcttgccgcaatgggaatgcgggtacagccgggggagggaaacgaagaaattatcggctcttatgacggtaagcatttcaggttgatgagcaatattgatttgggaggaatggagtggaatccgattggatatttcagggattcctctgagttttccggcgagattacaaataaatttttcggcagttttgatggaaacggcaaaactatttccaatttcagactaaaccgaacttcctggaacaaggttgggttctttggggcaattgaagatgctgcggttaaaaatctgaccttgaagcccggaaaaacagtatgcggccaaaaagaggttgccattctggccggcagcgcagtaaattcaaaaatcacaggctgtaccgtatccggcagcgtatcggcatccggaacatccggcggaattacggctgtaattgaggggagcggtccgtccctgtcggtaatcgaaaactgtatatccaacgtaacaatcgatgtcaacggaggaatcgatacatatgtcggcgggattgccgggaaggcggctggcagcagtattgtggactgccgggttgagacgggggataacagtacctcccggatacagggccgtaatgcaacggttggaggaattgccggattccagaatgcctctgatatttataacagctatgtatccggtacgattggcggaagcggctccggtattgtcggaggaattacgggaaagtatgcgtcaggacgaatgaaggtggcacgctttgagggaataatcggccagtcgggaaccggagcggccgggcacaggggaacctttataggacatagggaggcgggggattatttccgctatggcgcggatgttggatttttgtttgccgacatggagagcaaaattgcttttaacatatgtggaagcggaattccggatgacaatgaatatacgtattctgcaaatattgggtattcccatccgggcgatcctttctataccctcgtacagggcggagtatcgaaaaatatatcggatcagtactattatgaggttctggaaaaaggaattttatcgattattgatgaagatcacggcggtgccggtgcagatgaagccgggtattcaatcgaccattttgcccccaacgatgcaggccgcccgaccagagggtatttaattacgattccccagatagatacaatatcatcaggaacctattattacgatgtggcgatgctggaggcgcgcggagacggaagttattaccgtgcggttaataagggaaaaaggggagctgttgcgccgggaaagagtgtcacggtaacgacatcaccgaataatacggaagaagccaaatttcagatggacggggttccgacctatacggcagtaggaggggagaaagagacaacttatagaaacggcggcgaatacaccttcaccatgccggaggaaaacacggaggtgaaagccgtgtataaaaaagttgcggcaagggtatcggttgttccttcaaattttaatatcagcgttatacaggaacgcacaggcaataggaaaaatcctgtgaagacgacaaaggttctggatcacaacggaaagctgattgcctcctacatcaacggagcgcttcagcagggaacacaaattcagcctgtcttcattcaggctgttgttgatacaaacaatgatgtggcggacaattctgtcaaatggtccgtggatgatccggacctgattatacttgcggcaaatgacgatgaagacagggaagggttcacgaaaaaaagtgcttctgtctgtgtcaatctgaatgcgtccttccttgatgatacaatccggaaactggaaaaagagcaggcggacaatgcttaccggtacccgattcctgacaccattttcggagccgggcatcagaacggaggcgtggccgttctgacggcatcaaccagaccggccgccagctttgaaggaaaaccctgtaccggtaactgccggattaatgtcacctttcagataaaagataaaacttatgtggcaaatgagggggcggtcattgatcaagaggaactccggtttacggtgacaagaagactaacgggcggccggaagaagcccgaagaaaggatactggtaacaccgcctcaaaacttgactgcctcattttccccggacttttttgacaggaaagacatcacctggtcagtggacgatcctgccgttgctaccgtggatggagagaaccggtccgccggtgtcagtgtcaggaaagatgcaaaatggattcaggatatcatagagacagatgacggcatccggacgaatgagccttatgcagtccttggaggctccggcagcagggagacgaaggtaacggttacagcggacgatatgctgggaaaccgtcagacagcgaattgcaatattgtgatcaattttgtgacggaggatcagacggaggtttatgcggagggagtaattacagagccgcaaaccatgaatttcgaactggaatgtacgaaaagcggtaaaagaagcagcccggtaatttcatggacaggtgacggggaaaaaaagataaaagcagttgtgcttccggaaatggcctttaataaggcatgccgttttgaggtcagcgacgattccctgaagctggacggcgacggaacggtgacggtaaacagaaacgcaaaatggattcaggatacggataagacatatccttacacagccgttcacactgcgattattacagctacaacagaggatggaggattcaaggcaatctgcaatgccacaatccgatataaactgtctgatctgacatatggaggctccggcggcggcaaaggcggctcctccggcggtggaagcggctcctcctcaggcgtaagcccgggcggaggcattggccctgccggaaatggcccggctgcaggcacctcggctccggccggcagcgttgtcggaacctgggttaatacggcagacggtttatgggcgtttacagcacacggaagaatgtatcacaacgaatgggcctatgtccataatccatatgcaggcagagaacagagcagcacagattggttccgctttgatgaaaacggacatatggtgagcggctggtatccggatacagacggaaatctgtattatctgtggccgaagtccgatggaacacagggacatatggtgacaggctggcagtggattgccggagcagacggtctggaacgcagatactattttaatccggagccggatggaacgagaggtgcgctcttgaagaacacgacgttaccggatgggaaccaggtgaatgataagggggaatggacggtggaaggagtgactcaagtcagagttcctggtatttcgatataaataagaatcagggaaaattctcaaaatagagaagctgcagagcagtgtgggtgtaactcccactttcccatttatcaacgcagcaaaatcgatgcacattgacaactgaatagagattacacggttgaatgatagcaacaaatgatgggcggctaatggcacggcggccgcccctaaaaactatggaggaaacgataaggaaaatttaagatgaaccagagcgttaaatgaaaggcagataaagtaaaaaggaaaacataattgattgtcatagatgataaagcatgataaaataaccgtgtgtaaaagcaaagaagacagaggatagattccgatgctccttcggaaatgtacgaaggaggaaatgactatgaatacatcagaggtattgacattgctgctggtgattttcaccgcattgacatacagagagaaccatcggaaatagtatttttaataccctataaaagatagttgttttgacagataaggtgaaaagagaaggggatgttataatggcgagtatttacgaagaaggtttacaattaatagacgagaaatttggaaacggaaaagataatattatttcccttgcgaccatcgcccgagaatcgagtgctgacggaaatcctcgtccggttgtccgttgtgtggatgcatattacgaagactgcaccttttatgttgttacatatggaaaatcaaacaaaatgttacaaatagagcaaaatgcggaggtttcagttgctctctcctcggagatgtttactgctatcggagtaggtaaaaaccttggttgggtacttgagccccaaaacactgaaataagaaaaaaacttcgttcagcttttgcggactggtatgatatggcgaacaacgaaaatgatgaaaattgctgtattttagcaatttatcttacaaaggggaccttgaatattaaccattgggaaaaattatatcacctggactttgtgaagaagacggatatgaaagatggggggattttctaacaagactctgaatttcagaaattaataattaaattttaaggtcatttagcataattcgccttattaatatgcaaggggacttttaagcgttttttttgctttcagtcaacaaaaaagcgtgttgattataaatgagaaggaaaaaataatatgataaataacaaatacaaaataattgtttcgatgtttaccacaacaatcatatcagcagaaagggtgtatgcggagatttctctgaagaattccaatacttagctaaattcgtaggcttagaatgtgaagtatacacaccttcatatttacatcaggcttgtttattaaaaattaatggtcaatggtttgcaaccgacccgaccggtacagatccttttctatctaacgggaaaacatatccagtggatcaaaaaacaacagccggtttaattactgaagctgattgggcaagaattaatcctatggaagcagaactggatagaaaactatcagctaaggaaatatcatatgaagaatatgaaaagcaaatgtgtgagattttaaagtcaatgtggtaaaatggctgtagaaaaatgtcaagacatatgataaattattaaagggaataaccgtgttacagggtggttggccttcatcttacataggtgatgcagatgaaatttgacttcaaggatttgatgacatttggacttttcatcttggcattgctaacgttcgtttttacgttcgctagataaatgctttaaaccatagaaaaaccaccctctaaactttggcgagttagggtggattttctactcaaatatctggccaaccactttgtgggcggttattccttttgtatgtatattataactcaattgatgttatgattcaagaataagtttttattatagaataatttttaatgccttcaaccggcgctctgaaaagaacgtgggttgaaggcattttttgtttgaggtaattaggagaagaaaaaagatgaaaaaagttagtatgtggaaagagagaggaaagagagcaacgtcattgtttttgtcagtcatgttgtgccttatgacattttttccctacctgtcgtcattacaggtgctagccgcagaaaaggatacagtaacattaaccaccgcgcatggcgattttggtggcactcataagctttattgtatcgacaaaggagggcttgccatttggggaattgctgatgatggagatgtatacaagaagcataggccgtcagaagcggaagtacctttgtcgaaaaaagaacaagagtacatattttggggaattctaactcttcaagcatcattaggggttaagaaagcaaatagtatcattaacataattaattctaatgctccagcgcaaggaaaaattcaaataagaaagtatgtaacagaggaagatttaaaggcgttgatttatagctttagcgtccgagataagtattcatggctggaatatgttgctgctcataccgaggagtatttgaagatgggaggactccttggtggcagtggtggttccactcaaagcgggaaaaaagttcctgatataattgccgacagcacctctcttacaaccgcctatcaaatcaaccgttctgattttactatacactttgatgcgggtggagctgatgcagattttattcaaaaggttccaattgtattctcaaatgacaatggtgcaacatataaaccagagccgacagatggatggagctatacaaagacatcaaacagcattaccttttcaaatccaaaccctcaacctcccaaagcattaattaaatttgaagtagaaggaacggagtatgccagcacgggcggtgcttatgtatcagaagaagctctatttgatgagtgtctacaaatatgggaatgtattacctgttcgggaagacatggtgggggaactcctccatccactccaccttggcaacatcaacgaatggtttggctggaaattgatactgtaccaatagtgttttacgctgcccttgctggcgaaccggctgttagtgcggctggaggaggaatcactttccaggtttttcgccatgaggaagagtttaaatccacgtataacacacagctttataaatatgattatgaaaccggccagccgctggaaaatgcgaggtttgtcctgtttgagcggtttgatgataaaggagaaattgacaccgaaaaagatggcccggtacatatttacgaaggaggagaaccgtacgccagctatcataaggataaccctgttatttggtccggctttcggaatgttggttctgtggtgacagatgcaaacggacatgcagcacagacaataacccacggctatcactatgacaagacattctgtgatggtcatccggctcccacctttgttccggtacccgaaccagaaatcgaggaagaggaggaattaacagcttttgcggaggatgacgacgagggcggcgggattttaaacgcagaggaaattgaagcagccaaaacagtgaaccgggaattagcccaggcatggcttgactgtgtgtcagactgtgaagaacaggcctccggggcttttgagggagtacatttccattggctgatgtccgatgtagaccagggggaaattacaaacattgcaagttcaggcggagtcgagggcagcactccggacggtggaaatacaacagagccggattccgacacagcatatgaagaatcaggctgctatcaggacatgcaagaaacatatgagaagtttatatccttgaaatacagttacgcctatacggagtttcaggcaagggatggttatatccggcacgatcttcatgctgacgatctcccggtggaaattattacaaccgattcatcggaggccggtgcaaatgcattttttgccggcgggtacagtaaaaaagaaacgctggaaagcggagcagccggctattctaatcgaactgctgtaacagagaaaacggaagaaaagaaagaggtcgaaccgattcgtaagaatgtggcgaagcagctttttcaggaagctgcaacgactgtccaggacattgtgacgtatcttacgcctgaagctataacagatgaaaacgaaattgagtcagcagaagagcaggagaaaaaaacagccaacagaaaatctgcaccgtctatccctgtatttcagtttattgatgaagatgataaaaatgatatacaggcagctacaccatcacaggcagctacaccatcacaggctgctgcaccatcggaggcagccaccccgtcagaagcagcatttcaatggttccatgcggcatcttcattcagaaatcccaacgtcagggaaatggagacaatgaggcgggagctgttttggccggcttatgaggaggcactggccgcagagagcagtggagccggcgcggattatgggccggatggtaattacagtcactgcaataatgcagatcgggaaggaaatgcctggaggatttacgatcaccggacagaaggggaatttcatattaacaaaaaggatattgatttggcttccggtgaatcagctgattacagcgcatatggggatgctcagggggacggaacgctggaaggagcggtctacggtttgtttgcagcggaagatatttcccatccggacggaaagacgggagtggtttaccgggcaaacaacctggttgcgatcgcagcaacggataaaaacggagatgcctcttttcttgccatcacggaagcgccgggccgggcctatgattatcaaatgggagctgtcgttgacaccggcgacgggtggagggagaaagcgccaaagaatctctaccggtcggagcgctcttatgatgattattcagaggacggccagtaccggagacaatatacagacaatgaagcggacaatggaaattgctggatcggccggccccttctgatgggggactattatgtcaaagagctgtcccgttccgaaggatatgagctgtcaatcggaaaccgggccaatgatataacaaatttcggacaggatttagaggtaaaggccccggaagaatcgaaagggcatgcagtggttacacagcagctgtttgccgatgagcagacatccgatgatggaaccggagccaggccgaatgacttgtactttgcggcccgttcaaaagatacgaaggagcagaaatatgatattgtcctgtccggccttccgaaaggcgctgagttctatcgcagagaggaaggaaccagacagattgaggtacaggtgggaaccggaacgtatgaaaaagtcctgttgaccaatccggatggaagtccccggtatatccgcgcagaaaacgatcaccaatatttgaaatataatccggatggaagtccaatgatgaaagaggtgccaataaattatgtggccgaacggttccggcaggttacggtccggccactggacaaagctcttatacaggccgttctaaataaggccgatgggggaatgacggaagacgaaaatcagtcgatgctagttgaaacatttacttccggaaatcttttatttgtgaaagggaaagtggaaaaggcactgagaaaaaacgggaagtcaacgccgggaagacccctgccgggcggaggctatcgttattccacgatcgataccggtgagtttgataccggggtgcggcaaggagaggaggatcggtacggattgtctggagtgactccggggagccaggctgcatatacggtttacggttcccctgtgcggcgggtcgccattgcaggccaaaggccggatggaaccgcccttaccgtgggtgatgccatactttcaatcctgaactattacgacaacaatccgttttacagctatggaggaatcgatgcagttgaggcgtctggctttgattacatattcaccgtgtatgccggtgtcgttggaaagccggaaaactttatggttttaggaaatgatccggtggcggacagtattatttatcatgcagtgccccatattccgggtgacagttcactgccgccgagatacatttatgcggcatattccaataatccggattacgcagcgtttggtacgtatgaagattaccgggagggggccggcggttctgcggcccttggaagcgccactctgataaccgatgccgttgcggatcgagacgggaacctacaatcaaaaacagtaaaagaaaatgtctattatcagagcggggaattagtgcgggacagcagcggagcattgatccgggcgtttgagtaccgggaagtcacaagcacaaagctgcaggaggtacaagatgttaagtggcaaaaggtaccggcagagcggatggcggatggaacgtatgtccttccggtaaatgcagcttataccgattcctacgggactgcacatacgaacgccggtcatgaccagacaatagaattcaaggctgttctgaaggaaaaagaggtaattttatcagcggcagacgtttccgttttaggagccggttttgttgccggacgtccgatgaacagcgcaagctactatgtgcatgtaaagcaagccagagcaaaagcatacctggattatcaaaatatgaacctggtgggagataacacctacgtgcttcttacaagtctggcctatcccggacaagaaaagctttatcaggatggcggaacaagggagcagccggcccaggtatttgaacgggcaatccgccagaagattaaaattgtgaaagatattcagacaacgccggaaggaacttatgcgcacaataccaatgccgatgcaggccatcaggaccgtttcacagacgggccgggaggaagggcggaaaacgcatcaaaacttccgaatttccgttttaaactatatctaaaatcaaatctggaaagactgtaccgggatgaagctggaggaatagtgtggctcgatcggaatggaaacgaggcagatataacaaattaccgaaaagcttatccggtaaaagaaccgtatgccggtgtgcaaaaattctacacgaaagtgccgcacaaggaaaattccctgaccgcgggttctatcaataacaatgtatggaaagaagccgtcaccgtgaatgaaagcctgtatccttatgaggagaacaaaatgatcggggaaaatcagaacccgggttataccagactgcttgaaacgacaaccaggacaatggaggatggggacggtcaaacgagagaggtggaaaattacaattatgataagttttttgatgctctccagactgccaatcatgataaatgggacaggaaggataacgcaagcacctcccataagccatttgcctttatccgggaattaatattcgggacagccggcggggaaaaagcatacccggcagttcacaataattcagagacggagaaccgggtgaatacatctgaaccggccagggagaatgcaaagcgctctgatgcggtccgccagttcgccattacatggtatctggatggtgaagtgaaaaagataacggaggataacggaggcggagagagccaggcggccggagccggtgaaacctatcaggaggaaatttacgataaggcgctgctgcaggccattttgaaagcagaaaattacctgaagccgtttttcacttatgatttggacgaaatctattcgattgcctgggacagcgagacggatgggggaagcgacaaagatcggaccaccctggcggccgatacactccgggaaacagccggaaacggccttgaaacatcgaaggacggatatttctatggtgtgtcgaaatatctgccatatggggcgtatattgcggtggagcagcagccgtacagcgccggactgggagacttttacaataaacattataagacagataaaccgaaggaaatcgttcttccggctctctatgaagacggcggcaatgtggtattaccggaaaaactttgtgatatatatcaatacaccggtacggatacgccggaaaatttacaaaagaaataccatatcaggatgaacgaagagtggtcggctgcgcatacaggcgatttgagagactatgtgatacgggcacacaatcgtgacggagattttgaagtatataaatatgggctggctgcagataagctgacgggaaaaatagcctatccgggcggcgattacagttatcagggatttacagtcactcaggaagcattcgatccatacaaagatgtttacgaatgtgagaacacagccagtgattaccggagcaatcagaaagtagaaaaatattatcactacgcatcgctttctgaacaggctggaacagccgatgatgtattctttctgcatggtccggccgatgatgacaacaatccgtccggtttttatttcaaggatggagtaaaaaccatcaccggcgtacgaaccggatatgacggcctttattttgctgcgctggttccatggtcagtgacagagccggcagatgccgaagagtacagtgcggccgcattttccggttacgcagatggaaaataccgcaatacgttctatacttcccggctcaggatagaaaaactggattccgagacaggggaaaatattctgcatgacagtgcaatatttgccctttacagtgcagaccgtgaagatgccggaaacagcaacggccgggtgaaattctatgaacaggatacggtaatttccgggagtaaagaatttttggaggcgatgggagcgaataatatcacaccttttgccagaccttcgcttccctggcaggttccctataacggaaaatattatgggaccgtccccgccggcacgccagtctgtaaggaatcggagatgattattatgaccgatgcgtcaggtgaaaagacagggcaatttaaggcttataccaccacgaaagacagaggaaaagcaaacggcagccaaaatgtaggatatctggagacaccgcagcctttaggagccggctgctatgtgctttgtgagattaaagcgccggccggttacgtccggagcaagccggctgcaattgaaatttactccgacgaagttaattattacttagacggggaacgggataaccgggtggcagcggcgctttatgaggaagcagttaccggaacactcgataccggagatgtggcgaggctgtatctgaacaatactccgatccgcctggaaatgacgaaagcgaaaccggatgaggataaggtgaaatatgaattgaacggccgcctggagggcagtattacggagctgaagggccggtatggtttggagaacctggaattggcctgcaacagttccggggcgtatctgggttatggctggaagaaggggtttctggatgcgctgaaggcaaaacaggccgccggtgagaaaattgagattttatatgaagatggcgttttcaccgggaaagcatggctggaaaagcagttgaatacggccggtgacacgaaccgatatcttccgggtgcggtgatgacgctctatgatgccattgaggtgaaagtaaacggagacagtgaagatttccagtttgacggtgtgaatgtagagcgggatcggtatggaaatgtgatgaatatgtatgtgcaaaaagggttcgccgggacacagattaaattcgtgcttgataagacagagccgggcagtgacggactcacggattttgagcattacacctataacgatcaggaggatgacaagggagagggcacctggagctataaaaccgtagaacgggaaaatacggatattctttactatgatctgggcggcctggacgtgttgacggaggaaaaaggcattcagtacggttatgacaaaaatgcgcggaagatacaggctaaaaatggcgaaccaatctatggattaaaaaacggaacaccgtttttagagattatctgccccaattatgaggaactaaaatataacgaaaaggatcacgtttttgaaaaggttccggcggggacagaaatgtttcacctggatgcagacaagaaccgggacagccggactgcgccgtacacagggatggcatatgtggaggcggatgacgggaggattatggtgtggccggtcaggatttcaaaagatgaatacggcaatgtcattgccagagaaaagattacgaccagccgtattgccacgataaacgccgatacaaaagacgagtttacaatcggaacctataaggacggcgcgttccgtaaagtgatgaatccagtgttgaatggtcacggacagcccgattactatcagaagtcggaagagctgtactcaaagggcagtcccgtctatgaccgcgacggggattatgtccggtaccggtatgacgataaattgaaagcctacaatgacaatgcctggaggattgaaacaaaccgggatttactggatatcggcgcagaaccggaacaggcgggggacgaccggccgctgaaccgccgccagggagagagttatattattcccaatacctggacaacaggggaagcggccccggacgatccgttccgaagtgatatgacagacggacaggtggatgtactcaaacgcgtaccggcggggctctacattctggaggaattgaaagctcccaaaggctatgtaaaggcaatgcctaaaggactggcggttgaggacggttctgaaatccagaaggtgaagatgaccgaccggcctgtcagcggatactttgaaaagctggatgccccggagtctttccgtgtcagggtcattgacaaggatcaggtcctggaagaaacgcagttcaggacagaaggaaaagccggtttttcatacggcggcgtggcaggggccggactggccctgtaccgtgccagacggaacgggcctgaaggcattggcaatcagttttccgggtaccgtctggaaaaggcggaagaaacgcctgcaagctggacggcactcgatgaacagaaccgggaacagacgtttacagcccaatgggtgacaggcgcggcgcccctatatctggaggccatcccgaaaggcttatatatcctggaggagacggatactccgtccggttatgtcgcttcgtcgatgggaattgagatccgggagaatgaggggctgcaatactttgtacttccgaacgatcatacgaaattggaaatttacaagtacttagagacggacggcggcagacttccggttgccaacagcaatcccgcagaatttgccctttacgatgcggaaaataatctggcagacgagtggacaaccgatgactgccgcgaatatacttcggttgtcgacacatcaggatacaggaagacggggatttccgatacaatcagaaaattctttaacccgggcaggcaattgtcgcccagcggttttacctataattatgaggaaatgttcagccgatatggaaccggatttgacagcctgtcgtgggagacggagcgtctggcagtgagagcttccgcttcggacagagtgttccggacatcggacggttttaagatcattttggaggaggacactctgattttccaggagggaatggaaccgctggacagggagggctttatcagaagctattcaaatgatgagaatgccctgacggttggatggctggcacagagatcggcaaagcgtatatcctccgagaatacgcagaagaacgaatcagtgcggcagatatgggagacagatacaggaaaacagattttgatatgcgcagggaagaacatgacaccggagggaacgggaggatatgtttatgattataagtttaactataaaaagctggaatccggacattttcccaatgcggtgagctatgacaccccttcgggaaaccaccggttcgactatataccgcgcggccgctacaggttggcggaactgaaggctccggacggctttgagaaggcggaggacagaatccttgacgtggaagagacagcggacatccagctatactccgtaaagaacaagccactctatctttatattgataaggtttctgaagacggaaaaagtctggcgggagcagaactggccctgtaccgttcggacagcagcgggaatttcataaaggaaaaccaatacctggaagatacctggatttcgggggaagagggcttctatacgatgaaggattactacgatggaacgataccggatgggtttctggccggggagatgaagccgcgccggattggtttccttacggaggggatttactatttagcagagcatagagcgccggaaggctttgcacggatggaaccgcagagaatagaaatccccggagacaggacggagaatggaatcctgcgcgttaccgccaggaaccgcctgaagaaagggaaaataaggatagagaaagaggcatcggacagtggaaaagaacttccgggagcaaagtttgaagtgaaaaactgtaatacgggagagatttattccattgtaaccgacgaaaaaggatgcgcagaactgaccgggctgaggacaggggaagtaagagacggaaaatggataccggataaatacaccataagggagctggctgctccggagaaatatgccctgtcaccgacgatacaaaccttctatttcgacggcaaggaagacggggagacactcgctttcaattggcaggtgaaaaatgagccgactgacatcggcatatccaagtcggatttttataccggcgaatttgttgcaggagcgaggctggctatttaccaggcggccgaagaggacggaaaatacattccgtttggcgaaccgctcgaagagtgggtttccgacgggacgagacacagagtcagaggaaaattgacggccggaggcgtttacttcctgaaagagcttaaaagccctgccgggtatctgaaggcggagcctgttctgtttgttctctcggacgacggcaggaaaatcagcagtatccatgaacaggagcgttcggtaaaccttaagacggccgagctttttcaggatgcggtggaggaagtatccattcagggaagaaaagcggtgaagacagaggtctggcttacccggattgggacagagaaaacgatagtggtcccctcttatcagactgcgcccctgacggcagccgacggcattgagcaggatgccctgtatgaggaaaaagaaattactttctttaccgatcagaattccagaatcacccggcgtctggtattcagaatgaatctggatgcagccggggaatacaggccaagtcttcggacggcggaaaagacggtcctgaaggctgagacatcaagcggagggctgcttgaggaatgggaggttgaaaacagagagggattcgggtaccggcacatcatctgcaaccctgaatacgaagaaaagaacaatattaaaaccgtgggtgataacggaaaatatggagcggcagtcatgccggatacggttattaaatacgaaattacctgcaaaaatacgaagaaagagaaaagggacatcaaagttacggcatgtttggatccccagactgagtttatgcccgctaattctgaaccggagtggagggaagatgagcaaagcgccgtcgggatgacattaaagggagttcttcccggagaagaaagaaaaatcattctgaccgcagcggtgaaaaaggaggcaaaagagaaaatcgtttgcagggcacagatagacaatgccgcattcttacaggaaaacccggttgcgggggaaggaagcctttctgtggtgagctgtctgtcgggaactgcagccgggcagcttaaaggccgggaatggcagtacaggctggagttgtgtgatgagacgggtatgcagttaaaaggcagctttccttataccggcgacagagagggggtattcaaaagcggcggagttctcacgctgggaggcggtgaacacgtggtgctcaccggcatcccatggaatacaagataccatgtggaagaaattacggaggcggaaccagacggcagagccgaatttaacacagaaggaacaaccgggcggaaagcggaaagcgcggtattcctgtataaaatgaatgatggctctgtcagagagctgttaaaaaagggagacgccttccatttgacagaggtaacctgttattcggacggagaagagcttgtcacaggaaagacaacatttctgctggatgaatccgcctcggcagacgggctggatatgaaagatcagccggtccgtgttctctttggcaaaacggaggtgaatggtgtggacgagcttcccggcgcccattttcaattgaagaatgagagcgggacaatccttgatgagtggatatccgacggacagctgcatgagacatcggctttactggaaccgggaaagacctactgcctgactgaaataagtccgccgaagggatatttaagggcagaggatctcttttttacggtttctgaagacggcgccgatacattaatcagagtgagtgacaggcccaccagtgtggatgtctctaaaatcagcgcagagacaaaagaagggctgtcaggagcagagctggaaattaccgatgaaagcggcatccggatagaaaagtgggtgtcggatggaaccgcccatgtgctgaaagggaaactggaggccggtaaaacctatattctgcgggaaattactgcgcctgccgggtacagaacggcggaaccggtgaccttcacagtgtcagaagacggcagcatggatcaggtcgtaatgatggacgttcccaccagtgttttaatagaaaagattggcctggaggcggatggaacgacggagacgggctttctgggaggcgcgttaatacggattgaggacaggagaggacgagaagtataccggttcctcagccgggatgacgctgcgcatgaggtcacgggaatcctgaaggagggagagacttacacggctatagaggaggaagcgccatatggctatgagagggcggagccagtgaaatttacagtttctgccggagaagagaagattacggtcaggatgaaagacagaaagaagcctgaaaatccgccggataaaacaggtaaggacagtgatttgactgtaatcctccataaatacgacggggtcacgatgaaaggcctgcccggagccgaatttgccatctatcacggggacggccgtttcttaaaaaatgtatccacaggagacggaggacgtgtgcggctcgaactgcccgggccgggaacctatattgcggtggaaataaaagcaccacagggatacggcccttctccggacgaatatcaatttaccgtaacaggaaacgagggcacagtaaaagaaattcagattccgaattacccgttgtcagaaaaggctggtttaattacggttcattatgacagaaatctgaaagggacaggcaatatattccttaagaggaaacggctttctccgctggctccggccggagacagcggcggacaggccggggagctgattttggcagttctctttttatgcggaacaattatgctgtggtcaaggagaagcaaaagaagcagggaggataaaaaagaatgagaaaaaggacaggtaaaaagatattttctgcaatagcagcctgtctgcttgccgtgacggggaatttccccgccatggcggcagagataaaaaaggtcaggctcaggcttacggccgaagacttcgatgaaagcggaaggccggaggcagagtttcagacagacagtgaggcttacgaagtcagcggcattgaaaaaaatgaggaggatatttatgaggtggaactgacggcactagagggaaatgaatttgcggttatgacccagtcggatatcaggctgaccggtatcagggcgtcgtgcagcagggcagtcagaaagaacggaagagggacgctgagcctgtccgtcaaagcggaaggactctgcgatgtaaccggagaaatcgggaatgcccggtttcgggaaacaatggcagaatgggacaaagcagacaatgcatatgcctatatggttcttctttacagaaattcaaaacggataggccatccccataaaacccagggaaccacctatgatttttcaccgctgatgcgggaacgcggaatttatcattataaggtttatcccctttccatcaatgataaaaaggggattccggtggaatcggaatggctgtccctggacgaagacagggccggtaagaaccgtatggaatacgcagacagggatgagaaccaaagcggctgggagctttgtgaggagggatggagatactggctgaaggatgggacatttcctcaggataactggatgtatctggatgaaaactggtattattttgacgcagacggttatatggcggcagacagaacagctatgaaagagggacggctttgctggctggattcctccggactgctcagtgagggggaggaggtcccagacgagtcataaggctattggtcacaggaacatggggatttaactgaggtttggaggacgcgtccggaacggaccatgtccggtgtggtgagggggatggctgagtcttccgtccctggttgaaggttgtcgtgaggggggaatccggccggaatgaattcttacggggaccgtttgcacttttcgaagcgcatagccgtgctaaattcgtgagaaacctcattaagcacggatgggcttccatatcccctgcagaattgattccgcctacttcccccgttcaggtttttgccggggacggaagactcaggcggaggttttcgcggcaccggacatggtccgctccgggcgctgattgtctctaaccttaaatgaggaggaccctgtcgcggccactacatgtttccggcaaactgaaatcaaaccttccgcaattctttcataagggcgcattaaaggcatatcgtattttccgcacacggaagcactgagtggtctcgacaaggtccgcccccgcacttaacgcgtgagactatcagcggccgcaggccagtggatggggccgatacacccggcggagtctttcgtcccggcgaaaacctggccttggggcggaggggaagataaagtctgcggatgccgttgaaatccatcgctgattagcgaggtcccttacgagcttagcagcgcgatgcatttcacagagcgggagcgtgctccgcaggctttatcttcgcccgcagacccaaaccacaacaatcttcccccgggacgaaagactcataaaacaatcccaccaccccgtccgctggcctgcggcggcgtcctcacctgcttaactaaatctcctaactgaccttgtgtgaacaataacgtcataagaacaggttataaaactaattattaaaaaagtataaataaaataaaaaaagagattgaacataaaagagatctgtgataccatgtaaagcacaaatatatatcctatcagttccgccctgcatctgttcaggaggcggacgcttccttctggagaagcgatagggtactctggagagtctccatttattaggagcgccgaaggtgtaagacagattcaagtccatggtatctgtcgatctctcaggcaaaaggacagggcatacataaaaagcaatgggagaagctcccgttgtatgcaaatgttctactctttggagagctggtttctatcagctcttattttattgccgcaaaacggcagcgcaattaaaacatagaggaggataacaaaatggacgcattattggaagtggtatcaaaaggtaacgattttctctggagctttctcctgattctgttgctgtgcggtacgggagtgtactacacggtcaggctgaaattcatccaggtgagaaaattcggtgaaggatgcaggcaggtattcggccatatcaagctgaatggtgagaagcatgagaagggggagatgagcccgttccagtctatcgcaacagcgattgcagcccaggtgggtaccggtaacctggcaggcgcggcgacagccctgatcggaggcggccccggcgccatattctggatgtggatcagcgcatttttcggaatggcgactatttatgcagaggcggtgcttgcgcagacctataaaactgaagtcaacggggaagtgacaggcgggcctgtatattatatcaaggcagcattcaaaggtacattcggcaaggtactggccgcattgtttgcagtctttatcgttctggcccttggattcatggggaatatggttcagtccaactccatcggagcagccttcgtcgaagtgttccatgtatttaacctgaatattccgccggtagctgtcggcgtggttgtagctgcatttgcggccttcattttccttggaggcacaaagaggcttgcggcggtagttgaaaagattgtcccgattatggcaggtgtctacattgtgggaagtgtcattctgattgcaatgaatttcacccagattccggcagctttcaaaatgatttttgtcggcgcttttgatcctcaggcaatccttggcgcaggagctggtattgcagtaaaggaagccatccgttttggtgtggcaagaggtcttttctccaatgaggccggtatgggttccacccctcacgcacacgccagggcaaaagcggagtcacctcatcagcagggactttgcgccatgatcagcgtatttgtggatacctttattatcctgaacctgacggtgttttccgtactgactacaggtgcgatgagctcaggtaaagacggtacggctctgacacaggcagcgttcatggagggctttggtacatttggtatcgtgtttgtagcggtctgtctgctgttctttgcattctccacgatccttggctggcatttcttcggcctgatcaatgcaaagtacctgttcggtgaaaatgcagccaaagtttattcctttattgttgtaatctgcattatcgtcggttccgccctgaagctggagcttgtgtggtcactggcggattttttcaacggacttatggtaattccgaatatccttgctcttctggccctcagcggagtcgtcgtgaaggcagccggaaaaatgaaatagaaaaacggcggtggtataccaggcgggccttttaccgccattggtataatacgaaaataatacgaagttaatacgtagataatacaaagacgccgcgggattcatggtgttttatccataaatcccgcagcgtcttttttattgatggcggtgacctgtgcgcggagcgtgcaggtcaccgtttgtgcctggcctttttgctggtattcgtaattttaatggggatggggcggttccggcggggtcatttcccggtaaccatcatatatcggttatgggcgtctttcatacaggcaatcaacggtttttgcgtcagggcaaaataccgctctttaattgtcttttccagttcctccaaatctgttttgatgctctttccaatgaacagatcggctacaaaattccttgtgactgcaagaatggtattgcactcaatatccaggattttaccgctttctttttctacaaccagacttatgtaaaattccccgtgcagggtgtagatggcatcctcgcggctgggtttagcctgtccaacgatcagcagtgtgttattatcatacatgatttacggctccttttggcaatcgtttttgtttcgtatccagtattcatataatccggtttgccggtctattttagaattataccaagtacaccatgatatttctacagaaaaataccgcgatcttcttattgctgcttcagaattattccggttggcataaaaggggccgatatgatagaatgatcgttatgagagcaggaagataagggggataaggggaatgacactgaatcagttgaattattatgtggaaattgtcagacaggggagttttacgaaggcggcggagaaactttttgtcagccagtctactttaagtaaggcgatccgggctttggaggaagagttccagatggaattaattaaccggggagcaaaggaattccagctgacaccccaggggaatgtatttaatgaatatgctgtaaagatactcgatttttaccatacccagacacaggaattgttccagcggctgcacagcgcggacggaaccttgaagctgggaatcccgcctacggccggggcgatatttttcttctcaatcctgtatcaattccgcagtaaatatcccggtatcgatttgcagattgaagagattacttccaagacgcttcatgagatggtggcggcagggaagcttgatatgggggtggtgattgagccttttaacgacgataaattttttaaacggccaatctatacgtccgaagcggttttactcgttccgaggcagcatccgcttgccgcaaaaaggtgtgtctctttttctgcgctcagggatgaaaaatttcttctcgtaacgccggattatatgttccatgatgtggtcagggaaaaatgcggggaggcgggattttctcccaatgttacgtttgaaagctatcagtgggaactgctgtttgagatggtggcggacaaccaggggatttgcattctccccaaacctctggtggataagttcaacaatacacgggtgcatcagatacatctgaaggaaccggaatttccatggacactctctcttatttaccgtaaggataaattcattacggttccgatgcagtgctttttggatttgtgcttcagctcctgacagaaggagagggcttggcccattggacagtgaccggttatcggagcctgccggacagattctgcaaatgaggcagaataaaaagattaaaagattacacaaatgtccttgatattcatttaagacagatgtagtgtaaatgtaagataactgtctaaaaaagatgacaaacataagggcattggaattaaggagttgaaattatggataagataaaaaaattaccggatgcggaatttgaagtaatgaaagtggtatgggccaacgaaccgcccgtgacgacggccgtaatcatggagcagatagggaaagaaaaggagtggaagatacagacaattgtgtcacttatgctgcggctggcagagcgggggttcctgcgatctgaaaaaaatgggaaggaacgcgaatatttcccgcttgtggccagggaagattacctgaagtttgaaacaggcaactttatgaagcaatatcacgacagctcactttttaatcttatcaataccttgtatgatgataaagcactgaccgacgaggatatcgatgaattgttaaaatgggcgaaggaacggagggattagtatgcggggcatgcccgatccccagatctattcacaatattcatcttatggcgttgcaatctcagaggatagggagcagcagctttataacggacagagagtaaggcacaggaatatcgttctgatttcttcgccggcgacttaaacccggtgggaggaacgcagactgcaggaccgcgatatattacagtatcaggggcagcgagtgaaattatttgtcgataagctttccggcaactcctttgaaacattctggtttgacgaaggcggaacggtaaatctgtccgtcgtaagagattccaacggacaaatcacggaaattgtcagcatgtccggggaaaaagcacgggaataccatgcagcgctgtcggaatagctggaaaagcagcaggaagaggaagtaggaagaataattaggaaaagaaagtgcccgccggttttacgccggacgggcgctttttgctgaagacggtgtcttgtgcgcggagcgtgccggttatcgtttaaggcagtaaaaaggttcccggaggattcccggcttccatgaattcaattcatcccacatgaagaaaggctatttttcatttataaaaagccatgctataatcaaaccacaaagccgcagtggccatgcggtgcagcagataaaacagattatagcgctttaatcgtctttgaaaagaagaaaggaattgtgaattatggggaatcaggagatgaaagtttcttcatcgagagcagtcatgattgagtttgtaatgttttttacatatgcattttttgccgttaactggattgcggggagtacattgacaccacagattatggagcattttaaccttaaaaccttcgcgtcggcgacctttatctctaatgcgattacgctggcaaagattatcggcaactttatggccgccggcatcttaaaccgtctctacccgaaaaaggcaatcggccttggttccgggctgattgtactgggaagcacacttgcaatatttgccccccagtactggctgtttattctcggaagatttattatgggattcggcggagcgctgtacgtagtatacttcagtcccgtcgtcattcattactttgagtctaaaaaacgacttaccgtcaatgcattgaacggcgcagcgtacaatttcggtggtattgttgctatggtgatagttgggccggttattatatggcttaaaacctggcagtacagtatgggattttttgcagcggtaagcgcgcttttatggcttttatggccgctgttcggacaggattttgaattgaaccgcagcacgggaacagggcaggctccctatacgataagggaggccatgaaagaaaaaatcaactggattctgccttttacctattcgggattgttgactttttatatcgttatgctgaatattttccctatatcgggagttacggcaatcagcagcaaggcgcttggcaccctcgttgccatcggcggaatcatcggttccctccttgcaatcgcgttggggaaggtatattttaaacgccttccggtaatccgttattccggccttgccatgactctgttcggcctgctgatgttaaggacggacagcagcctgctctcggcagtggcggcgtttcttatcgggatgtttatgttcctgccggtcagttccctgatgatgataccgcaggaactgccggggatgactccttcaaagcttacgacgataatgggcctcttctgggcgttgtcctatataattgaaacggccgcatactttatcattggctttattatagaccgcttcggatatggaatgggactaaacttcgcattgattatgagcgtgactttcttcctgggctccttcctgctgccggagacaggaaaaggcggaaaatccgaaaaagtaaatgcaaaacttaaatgcagttagcagggctggatatggcagctcagtgagaaaatattttatatagaaaaggagtcgaaaatgaaaaatttaaaagaaatatacagtgaaaaattgatgacagccgatgaggcactggaactgataaaagacggagactatatgttttccgcgcaggcagccggagaaccggcagaaattctgtctcatctcgggcatttgaaatgtacaggggtgaagaatacgactcttaacacctgtctgccgttacaatattatgaagcatttaaagatcctgaaatgcagggcgtcatgtcacacaacggctggtttttcagcccggggctgcgcgatgcccataagagaaaactggtcagtgcagtgccacaaagctccacctcagttttgcgcaaggcgctgagccgtctggaatatgaggggcgcaggccggtagcgctggcaaccgtctcaccgatggatgagcatggctatatgtccctgtcggtcagcgctatttacgagagggatttaatcaactatggagcgcttacgattttggaggtgaatcctaatttccccaggacattcggggatacccaggtacatatatcggaagttgacgcccttgtagagtcaaaccgcccgattccggtgagcaggctggccccgtatacggaggtagacgctgcaatcggaaaatatgtagcctccctggtggaagatggttccacgattcagctcggtatcggaaatattccgaatgcagtggccgcggagctgaaaaataagaaacacctgggaatccatacggaaatgtttacagaaacaatggtagatctgattgaatgcggagcagtagataattcctgcaaaggcctgctggacgggtactctgtctgctcctttacgatgggaagccagcggctctatgattacattgacaacaatccggctgtattgttcaaatcctgtacgtttacaaatgatccgtataccattgggcggaacaataagtttgtctcggttaacgccactctggagattgatcttacaggccagtgtgcgtctgagacggtcggttacgaccagtggtccggtaccggcggccagtcggagaccgtacagggagcccagatgtcgaaaggcggcaaatccattattgccatgcactccacctataaggcgaaggatgaggaaggcaatgaggtgcttcgatccaaaatcgttcccttcctccatgagggagccgttgtcaccacctccaggaatgatacggattatgttgtcaccgagtacggaattgcatggctgcgcggactgaatgtggggcagagagccagggccctgattgccgttgcacatcctgatttccgcgaagagcttcaggctaaagcggaggagtacgggatctggtaaagatatagcaagacttcagggtgcggtctgtctgaccgcaccctgaagtcttgccttgtcaccgggaaaatggtaaaacctggccagacggtcctcgacgtcggaatcaacgtaaaccctgttccgggcggtgtcggctcagtcactgcttcggttctggcaatgcatacgatagaagcggcggaaacggcggcgaagaaagacggcgtcccgcatgtccggtgccggtgataaagaggaacggttcaggaatcgtttcccccatggttctttttgtcagctctgtaacggctcgcagaacggagagatggacatccagagccaggtggtctacggtcattgttctttccctggtacatccgtccacgcctccggcatcaacaacacggcgcagaagctcggtttctttctcttccgacggaagaagaaaacgccccgtttcaacagatagaagagcagccagcccccatccccaccagttggacacaccgctggccaacgcaatatcggccgattcacaggcacaaatttcagcgccgcatggaacatttgcggtaatttgcctgtaaaaagcgcccattcccatctcattgcccccgtctccgatggaaatggttactgcgccaagctttttggcttcggataagaagggggaggaatccgcgatcatatcgtcgataatttcaccgcgcatattgtggtaatggccgtccgccgcttttccggggcgttccaggctgatgaaatgagtcggtctgaaatcactgagaaaattccggataaaggcagcggtatcgttttttggaagcagcacgagggaggtctggggagccatccaacgcaaagcctcctttaaaagcgggtaagaagcagaatctgtaacaacggcggtatggcagccaattccgttcagagccgtggctgcggctgccgttccggacgggccgtccgtttcgccgataaagcttccatcagccaggcggaccggaaatcccgtcagcaggacggctcttttcgcaccggagagcgccgcggccgtttcagccagcggtgaagccgggagtgaggggagcagcccgcgtcctccgatatcctgtctcataatcaaatccaaagtcttataaaaattcatagcatcaatcctccaggtatttgcaatatgcatctgtgcgtggcttttctatccgcaggaaaattgttgctgtttgcaccaccaaaattcctgaaaataaaaaagacccacgcatcctgtaaagattcatggctcttatttacgaagggaacatccgggcaggagtcccgataaataaaagaatcgttttatttttcactcttattgtagcggaagcgaaggtatttgtcaatctatatgatagttaagcaggtgaggacgccgccggtacggccagcggacggggtggtggggtgtgtatatgagtctttcgtcccgggggaggattgtggtggtttggggctgcgggcgaagataaagtctgcggagcacactcccgctctgtgaaatgcatcgcgctgctaagctcgacaggacctcgctaaacagcgatgaatttcaacggcatccgcagactttatcttcccctccgccccaaggtcaggttttcgccgggacgaaagactccgccggtgcttagcgaggtccctcacgagcttagcactgatgcgcactccaaagagtgcaaacggtccccgcagcaattcattccggccggattccccatccacgacaacctcccacggggacggaacactcagccatccccctcaccacaccggacatggtccgttccggacgcgtcctccaaacctcagttaaatctccaattaggtttcagtaatcccccgccagtttatttcgattactcttttccgctccagcaataggtacacagcttgcagggggaaattccgattgattcaaccagatcgtcaagcctgtggaattgaagcgtagtgaaattgagtctttttctgatttcttccaccatatccttgtagttctggctgtccggattagcatagtcggccagaatttcatcagatacattatctccttcacggtcccgaataattcttcttgttatcagatccagatcggaattggaacgggagaaattgaggtatttacatccgaataaaagcggcgggcatgcagggcggatatgcacttcctttgcgccgctctgatacaggaattccgtcgtttcgctcaactgtgtgccgcgtacaatggagtcgtcgatgagaaggaggctcttgccgcggattagtgagtctaccggtatcagcttcatccgggcgatcagacttctctggttctggctggtcggcataaaggaacgcggccaggttggggtgtacttaatgaaagggcgtgaaaatggaatgccggattcgttggcataaccgatagcatgcgcaataccggaatcggggataccagccaccagatcggcctgggcatgatcgcgttttgccagcatacgtccgcagttatagcgcatttcctcgacattaattccttcataggaggatgtcggatatccataataaacccagaggaaggagcagattttcatctcttcccgtgccgggcttaaaatttctatcccttccggtttcatcaggacaatctcgcccgggccaagttcacggtaatcagtaaagccaagattaatgtaagcaaaactttcgaaagagacacagaaagccccttcttttctgccgatgacggctggggtacgtccttttctgtcacgggaaatgtaaatgccctccggagtaagaagcaggatggtcatggagcctatgattttctcctgggccagcagaaggccgtccacgatcgactcggcctgattgataatcgcggcaaccagctcggtcgcattgatcttgccgccgctcatttccagaaaatgaatgtggcctttttcataggcttcccgaatcagatcttcctgattggcaattttaccaaccgtcgtgatggcatagctccccagatgtgactgaatcagaagaggctggggttccatgtcggaaatgcaggcgatgcccatattgccttgaagttcatccacgtcgcgttcgaattttgtacggaacggagagttctcgatattatgaatagaacggttaaagccgccaggaccatagacggccataccgcctcttcttgttcccagatgagaatggtaatctacgccgaaaaacagatccatcgtacagtttgtcttagatgcaacaccgaaaaatccacccatttttaacttcctttcgatatttggtaagttcattttatatttattttaagaataaaagcgtcattttcatcatagcatatattagggggattggacaatagactttatttattaaaaatattaatagataatcacgtttttcatgataatgccatttttaccggcgaatggcaggaaaaatactttatttcctgcaaaccggggttcctttgaccgtgggcctgtgatacaataatatgtaatatagtaaagatttatttgaggagagaagatgattaaattgaacagaatgacaagaaaaagatgggcagccatgttgctggcagcggcttttatgattgcgtcagcgcctgcagcttatgcggacgggccttctggtccggcgtccgatacagcgattgcggagaacagcagggaagaggcgaaagggccgggggccgggccggagcagacaagccagccggaacagcagccggagcagacaagccagccggaacagcagccagagcagccggagcagacaacccagccggagcagcagccggagcagacaacccagccggagcagcagccggtacagccagaacagccggcggaaggaatgatagccagcggaggacgctacatcgatcccaccaaacctatggtggcgttgacatttgacgatggtccttatgcgccggtgggaaacaggattatggacagcctggagcagcataacggcagggccaccttctttgtggtaggcagcagggtaccgtcttatcaggctgagataaagagaatgcataacaatggccatgaaattggcaaccatacatatgaacataaatatctgaataagctgaacgcagcccagatccgcagccagattgaccgctgtaaccagaccgtggccgcggtgacaggcgaagctcccgcgctggtcagacttccgggaggcaataaaaacaatacggttctggctaatattaaccagccgatcatcatgtggaacatagacacactggactggaagacgagaaatgccgcctcgtcggtacagaaagtgctggggagcgtaaaggacggggatattgttctgatgcatgagctttatacggcttccggggatgctgccgtgacactgattccggcgctgaccgaacggggatatcaattggtgaccgtcagtgaactggcccggttcagaggcggactcagcaataagggagtttattatagttttccaaagtaaaaaaatatataaggaataagggaaataaagcgttaaaagagaatggctgaattgaggacagagggaatgtaaaccgcctgtcccaatgcagccgttttttattgaaggcggtgacctgtgtgcggagtgtgcaggttatcgtcaaacaggaaatttatccggttaaataaaccgctccgtgcaggagcgcacgaactggtttcttcccgggatatcagaccgctgtctggccctgttccggttaaggttccttctgctgaaaatttttactgcattcttttgataccataaaccgtcctatcggaatatcctaaagtaaagaatacagaaagcagggcgtttttgtggatcaggcaaaaaaatggattcactgcgacggggcataccgtctgggcctgacaggaaaaggcgtaggtgttgcagtcctcgatacgggaatatttcctcacagggactttgaaaatagaatcgtcgtatttaacgatatgcttaagagaaggtttctgccttatgacgacaacggacacggcactcatatatccgggataatcggaggaaaaggcctttcttccgatgggagatatcagggtgttgcaccggagtgcagcctgatcagcgtaaaagtgctggatcagaaaggaaatggctttgcctccgatgtgctgtcggggcttaaatgggttgaaagacacaaacaggaatatggaatcagaattatcaacatatctgtaggttccttcagcaaaaaggggatgagcgaagattcagcgctggtaaggggagttgatgccgcctgggatgcaggctttgtggtggtagtggcagccggcaacaatggtccgggccagcataccatcacaacacccggaatcagccgtaaagtcattacggtaggttgttccgacgattataaggaagtggatgtggcgggaagccgcatgatagattactctggccgggggcccaccagcgcctgcgtatgcaagcctgatattgtggctcccggctccagtattataagctgtgccaacagacagaacggttatacggtaaaaagcggtacatccatgtctacgcctctggtctcaggggcgattgcacttttgctggaaaaatatccatggatgagtaataaggatgtgaagctgcatctcagggagcgggcggtggatttggggctgcctcataaccagcagggctggggccttctggatgtggaacgtctggtgagataagcgggaagccgcccccgaacaaaagcggcgttgacgccctgaagagaaattccggccgatatctgaaagggccggtgccgcgcagataatgaaagctttctgcgcggcaccggcccttttatattaattacagtgacctgtgcgctgagcgtgcaggttatcgtataagcttacataatctgtctgctgtctttcagcattacatcatgtgcgccgccctctacaatacttgtggaggatattaatgtcatttttgcattcttctgaagctccggtatggtcagacagccgcagttacacatagtggaacgtaccttgcttaaggaaaggcccacattatccttcaggctaccggcataaggcacaagggaatccactccctcttcgaaagaaagctttgcatcgccgccgagatcatatctctgccagtttctggctcttgcgctgccctcaccccaatattccttcatatagcttccgtttatatttaccttcttagtcggactttcatcaaaccttgcaaaatatctgcccagcatcaggaaatccgcgcccattgcaagggccagcgtgatatggtagtcatggacaatgccgccgtccgaacaaatcggcacataaacgcctgtttccctgtaatactcatccctggccttggcaacctctatcagggccgtagcctgtccgcggccgatacctttctgttctcttgtaatacagatggcgccgccgccgataccgactttcacaaagtcggcgcctgcttcggcaaggaaacggaatccttcgctgtctacgacattgcctgctccgactttcacggtgtcaccataattttccctgacatagtcgagaacaatcttctgccattcggaaaatccctcggagctgtcaatgcagagaacgtcggcgcctgcttctaagagggcggggatccgctctgcgtaatccctggtattaattccggcccccaccatatagcgtttggaggaatcaatgagttcattctcattggttttgtgagaattgtaatctttgcggaataccatggagacaagacgctgctctttgtcgataatcggcaggctgttcagcttatgctcccagattatatcattggcctcttttaatgtagtgctttcatcggcacagattaaatgctcgaagctggtcataaaatcggctacctttgtatcgagcgtcattctgctgaccctgtagtccctgcttgtaacaataccgagaagcttgcccatggacgttccgtcggaagtgacggctacggtggaatggcctgtcctctctttcagctccagaatatcggccagagtattttccggtgtaatattggaatcgctgatgacaaaacctgccctgtaatttttaacgcgtgataccatctgggcctggctttcaatggactgcgaaccgaatataaaggaaagacctccttctcttgccagtgcaatggccatgttgtcgtcggatacggactgcatgatagcggaggtcatgggaatatttaaacttaaagagggctcctctccctgtgcgtactttaccagcggagttttcaggctgacattagccggaatgcatttcgtggatgagtatcccggaatcagcaggtattcgccgaaagtacgggatggttcgttcatgtagattgccataatgattcgtctccttatcttttaatttatttaaagtttgattcctgttttatctattctaactattatacttaactggtttaccgccgtcaatgggggccggtaaattttgctgtaaatgtctcacgcctggcaacagttcagacggagacttttttgtcggaatatatacaaaatactttacaaaatgaagaaaaaaccttccgattcagtatattttcaatagactgtacatgcaatcagagatataataatgacatctgaagagtaaggatacgagcgttaagtattggccggacggggagttgccggctgagcgaaaagcccaggcttgcggttcgtattctgcatcctgcttcatacggcaatggaacagagactgtgaggaaacagccttctttacttgctatatgggcaaggttaaaaggaggtattttttatgtctgcagaaagacaaacagcgaaaacaggaacgagatcttcttttgggagcatccaggtattgattatgatggctttgtttattgcgctcagtattgttttgggcaagcagctgtcatttacggcgggaccgttccgaatcagtttcgaaaacctgacggtattgatggccggaatcttttttggaccgcttgccggtcttacggtgggggcctgcgcggatcttatcggctgcctgcttgtcggatacgcgattaatccgattattacggcaggagcggcgtccgtgggctttatttccggactggtgtacaagaactgtttccgtacgaagccgaagctgagactggcggcatccgtgggcgcagcccatgtgataggttccatgattatcaaatccattggcctgcgtatctatttcggatatccgctgcagatggtggcgctgagagtgccgctgtacatcgtgatcggctgtgcggaaggatatatcatctaccttctgctgcgcaataaagcttttggcagacagctggaaaggatgaaagacagatgaaatacgaagaggcagtaacatatataaaagaaggagtttctcccggcagcaggccgggacttgagagggtgagcaggctgcttgcccttcttggcgatcctcagaatgaactgaagattattcacgtgacgggaaccaacgggaaaggctccgtctgtacgatgctggaatccattctcggagcggcgggatataagacgggactttttacctctccctacatcagaaagatgaatgagtgtatccgcctggataaacaaccaatcagtgatgaaagcttttgtgatattattaattttatccgccctctggcggatgcgatggaggacaggccgactgaatttgagattctctctgcggcagccatgaaagtctttcatcaaaagaaatgcgatgttgtaatatgtgagaccggtatgggcgccagacttgacgctaccaatacgatgaaagagactctggcttccgtaattgtaaatgtggagctggatcacatgggatttttgggcgacaccatagaaaagatagcctttgaaaaagccggagtgattaaacagggctgtcccgttatatttggcggagccagagaaaatgcaaggcaggttatcgaagaacaggcaaaagcccgaaaagcaaagctgacaatggtagattataacgcattggaaaatgtacggacggatctggggggatgtacttttgatttcaaggagtacagggatatcagactatccctcccgggcctgtaccagccatccaacggggctgttgcactgactgttatttccgtattgaaggaaaggggactggccatcagcggcgatgcagtcaggtcgggcatgcagtcagtatcatggccggcccgatttgaaacaattataaaagaaccgctgacaatctatgacggggcgcataatatggcaggaattacagtggccgtagacagtatccgaacgtattttgacggacagaaggttaatatttttatgggtgttatggcggataaggaatatgatgcgatgatcgagctgctgaaaccctatacgaatgcggtctacaccgttacaccggccaaccccagagcgcttccggcagaacggctggcggactgcttcagaaagcacggcgtccggaaagccgaagcatttgatacgcttcgggatgcggcggagtgtgccttaaaggacagcatgagagagggaaaacctctgattgccctgggaactctctatatgtatgaagaggcggaacggattttccggcagtgcgcggcgcaacgataacctgcacgctccgcaatgcacagaaacggtaaagatttagttaagcaggtgaggacgccgccggaacggccagcggacggggtggtggggtgtgtatatgaatctttcgtcccgggggtttggcatcgctggctggagaaggagatactgtggttttgttttcgcagggcggagccggatatcattctctccttctccgccggaagatgtcggcagtatctccttctcccggaaggttttcgccggaacgaaagactccgccgggtgtatcggccccgtccgctggcctgcggccgctgatagtctcacgcgttaagtgcgggggcggaccttgtcgcggccacttagtgattccgtgcacgagaaatgcgatatgccttcaatgtactttttttaaaattgcggaagatttgatatcggcctgccggaaacacgtagtggctgcgacagggccctcctcatttaaggttggaggcaatcagcgcccggaacggaccatgtccggtgccgcgaaaacttccgcctgagtcttccgtccccggtgaaaacctgacccggggaagtaggcggaatcaattgcggaggggacatgggagtccgccggtgcttagcgaggtccctcacgagcttagcactgctgcgcactccaaagagtgcaaacggtccccgcagcaattcattccggccggattccccctccacgaccaacctcccacggggacggaagactcagacagcccccctcaccacaccggacatggtccgttccggacgcgtcctccgggcctcagttaaatctccaatctattgcactgttaacgaaaagacattgggccgtgaatagtaacattagaatccgcctaaagcggcctgcggctgatagtcttatgaattaaggtaactgttcatgctgtctgaactgttacgaatgaggtgaaaaacatgaatatatcggttataaatgaaaatacagcgggaaaaagaggctttctcgcagaacacggtctgtcactgttgatcgaacacgaaggaaagcgctggctgtttgataccgggcagacggacgtattcatgaaaaatgcggcactgctgggggagcggctcatggggcttaatgggattattttgagccacggccatttcgaccattgcgggggcctcaaatttctggcggaagaatatcggaaggcagggatagatatgcctcccgtctatgtcagggagacagccttcttgggtaagacggcaatcaacagcgatcgccggacttaccgcatcataggcattccctggaaaagggaactgattgaaaactcgatcaggctgactgaaagaaagcaggagattgccccgggagtatgggtccttggcgacatcccatatacgccgggtctggaaaagaggccggaacagtttttcattgaggacggaccggaaaaaaggccggactacatgaacgatgaacagatgcttctctttgaaacagggaaagggctctgcctgtttgccggctgctgccacccagggattctgaattgtctggaatacgtgtcacaggcatttcccggccaaaagctgcacagcgtctttgccggaatgcacttaaccggcgcatctgcgcagcggattacagagaccgccggggagcttgaaaaacgtaaatttgatattctcatgccggtccactgtacaggcattgaggccatcggcagaatgaagacaatgtttggcgaacgctgccgtctggtggagacaggaatgacgctggagctttaaccgcccagcgtcacatcttgtctggagtaccaggaaatcgcttcctccacatggcgcggtgaaaaatccggccagtaatcatccacaacatagaagtcggaatataccgattggacaggaagaaaaccggacaaacgccgtctgcctccccaccggattacgagatccacgcgggaaacatcggcagttccgagttttgggccaatcatcccgttctttaatcccaaatcccattcccagctgtaattgacaagaaaattaattttcattccgccttttccgaaatcccgtctcgtggtgtaaggcaggagttccttaggaaacatcgcggaatccgtattgccgaccaccagaagacttgcgttttcctccgaaagtacctttacggcggcaacgcatgcttttgtaaaggccaggcgctgtacggaaggacgtttcgtattatcggccgtaaatccgtaaaaagacatttcttttattcccagcttctggcaggtgcggaataaagacatgccgggtgaaatgccgcgctcatatccatcttctttattcaggcccttttgaagcgcccatcttctgtttccatcggggataatccccacatgctccggtattctcaatttgatgtcctccgcagttatttatttgattggattattaccggaattggtaagattatacaggaaaaagacgatcataaaaggcagagggcggtacgccggtaagcgtccgcactctgcctgcattgaagacggcagcctgggcccattcgggccggttagctgcggtatttaataaacaaaccggtttatgtcgcggtttgcaccgagaataatcagttcatcgtttgctttaaaggtataatcagcgcccggcaggggatgaagggtgtcattgtatttaaccgctaaaatagaaatgttatattttttgcggatattcatttcaataatacttcttccgatccagccttcggggactggtatttcatatatggaatgttcaggagtcagttcgatgtagtcgaaaatattatcggagctgtagcggacggctgaccggattgccatctctttttcagggtaaaccacctgatcggcgccgtttctcagaagaaatttggcatggatgtcacggcttgcccgggagagaacaaattttgcccccaaatccttaagaagagaggtgatttccagagaactttgaaaattatctccgatcgccactacacagacatcgaagttgcggatcccaagggaattcatatactgttcattggcacagtcgccaatctgtgcgctggtaacgtacggaaggacggcgttgatcctgtcttccgaagtgtcgatagccataacctcgtgacccagctcatggagcttcattgccattgtggagccgaaacggccaagaccgatgattaatacagttttcattaatatatcctccagatatcatgataatcagccgacggtgatgcgttcctgaggaagcagcaccggaagcttctttcggtttgtcagtgcgtaaagcatggtcaggccgcctacacggccgaaatacattaataatattaaaataatttttgaaaaagtgcttaaatccccggtgatccccagggaaagtccgacggttgccacggccgaggaggtttcaaaagcggcctccatcagattcacgtcatccagccaggtaatgaggaacgtggccgtcagcatcagtgagatgtaaagggccagtatggcaatagcatttcgcaggatatcataaggtatccttctcttatagcactggatgctttcctggttctggaacgcagaacgcagacaaagaattgccagtgcaaacgtcgtggttttgattccgcctgccgtagagcccggggaaccgccgataatcatgagtatgaccacgagcagctgggccgcctccgaaagctgattcaaatccacgctgttaaagcctgccgttcgggtggtgacggactgaaacagggaagccataaatcgttcctgcagcgagagtccatcccagcagtccctggaaaactcaaacagaaacaggaacagggccggaaacataatcaggcagaaggtcgtggtgaggacgatctttgtctgcagatgataatatttatgctgaagtttatgggttttaacgtcgtcccagacgaagaaaccgatacctccgattataattaagagcatgatcggaatattgataagagggtttccggtgtagctggtgatggaagtcgtaggaccgctggtgcctcccatcaaatcaaatccggcattgcagaatgccgagatggaatggaatacggaaaaccagatccctttaataaggcccatctgcggacaaaactgaaacgccatgatgaccgctcctgcggcctcaaaaaaaatggttccctttacgataaaactcgtcatgcggacaattccgcctacctgaggcgccgagatggattcctgcattacgtaacgctgttttaagccgatctttttaccggacaggattgtgatggcaatggcaagcgtcaccacgcccatgcctccaatctgaatcagtatgattatcaccgcctgcccgaatacggaccagtaggtgtacgtgtcatggacgatcaggcctgttacacaggtggctgaggttgccgtgaacacagcgtcgataaatggagtcgcttcaccggtcttcgatgcaaaaggaagggtcagaagaacggctcccgtgataataatgaggaaaaaaccgccaaggattatcttggccggagtcagcgaccacacttgctttccaatcatattattgtattagctcctgaatttgatattatttattattgcctattgattatataaagaaccgccctggatgtcaacgtaagaaaatgtaatgattcaaccataaacaggaaactttatggacaagaggcgtttgaaatgatataatttccttacttctaaaaatcagatatgcaagttctgccgcaattcagtatctttttttgtatgacaggccgtccgtccggccccgtcttcgtttcgcgtaatccctgtgttactgtctgctgtattggaaaataagggttgacattttaagtcagttatactattataagaacatgaagagaacgtttgttcgcattgaaaatcgttggaggatgagatgaacagagatgataagatgaaggcattggatgccgcgctgacacagatagaaaaagcttatggaaagggctccgtgatgaagctcggagattccggggccaacatgaatatagagacggtgccgaccggctccctgagccttgatattgcgctgggactgggcggggtgccgaaggggagaattgtcgaggtttacggaccggaatcaagtggtaagacgacggtcgccctccacatggtggcggaagtgcagaagagaggcggaattgccggatttatcgacgccgagcatgccctggatcccgtatatgcccgcaacataggagtagatatcgataatttatatatttcccagccggataacggagagcaggcattggaaattacggaaaccatggtgcgttccggtgcggttgatattgtgattgtggactctgtggcggcgctggtgccgaaggcggagattgacggtgagatgggagattcccatgtgggtctccaggccaggctgatgtcccaggcgctgcgtaagcttacagccgtcatcagcaaatcaaactgtacggttatctttatcaatcagcttcgtgagaaggtcggagttatgttcggtaacccggagaccaccacgggtggacgtgcccttaagttctattcatccgtccgattggacgtcagaagaatcgagacattgaagcagggcggcgagatgataggaaaccgcgtgcgtgtgaaagttgtgaagaataagattgccccgccatttaaagaggctgagtttgacattatgtttggaaaaggaatctccaaagagggagatatcctggatttggctgccaaggaagatattgtggagaagagcggcgcctggtacgcctataacggcagtaagattggacagggccgggagaatgccaagaatttccttctggccaatcaggaactctgtgcggagattgaaacaaaggtacgccaaaaatacggattggcggacggtcctgccggagatacggcagagaagaaggacaaagggctggccccggttgagaaaaaggccgacgcggagcctgcacagaagaatccggcaaaataagtaaataatataaggaataattgcgaaagggcttaagaatgacggtagacaaaattgagccccttgataaacgaaggagcaaagtcttcattgatggggactttgcctttgttttatataatggggagatacggcattaccatattgaagcagggcaggatatatccgaaccggtgtatgaggagatattacacggcgtgatctgcaaacgtgccagggagaaatcgctctatcttctgaagagttccggaaagacggaaagcgaagtgaggcagaagctgaggtcaggccattatccggaagaggctgtcgaggaggcggtgtcctttcttaataaatatcattatctggatgaccgtgaatacgcaaggaactatattgaattatacggcagccgcaagagccggaccgaattgatgactgctttgctgagaaaagggatcgataaagagacaattgttgaattttgcgatgaactgcagcccgacagttccggacagattaaaaacctgttgaaaaaaagacggtacgatccggaatgcaccgacaggaaagaacagcagaagcatatggcatatctgctgaggaaaggcttttccttcgaggatatccgcagtgccatgggggcatttgaggaggaatagcctccgatatagtaacgtttttccagctttgttagatagtgacgaaaacagggtttcagattctaatatacttgacataatgtataaaacagtttaaaattaaatcgttgtattcttgtacaatgaaaactaaataaggaggtgctcctgtgtcacaagtaatagttccgctcattgcgagtattattgtagctgttattacttggtttgtggccaccaactaccgccaaaagacgtatgaaacgaaaattggcagtgctgaggaacgatcaagggaaataatagatgaagcattaaaagttgctgagactaagaagcgtgaagctctccttgaagcaaaggaagagtccttaaagacaaagaatgagcttgagaaagaaacaaaggaaagaagagctgagcttcagcgctatgaacgacgtgtactgagcaaagaagagaatctggacaagaagtccgaagcaatggaaaaacgggaagcaggtctggcaaacagggaagaggcccttaagaagagaaccgcagaggtggaagaactctatgtaaagggaacgcaggaactggagagaatttccggttttacttccgagcaggcaaaggaatatctgctcaaatccgttgaggaagatgtaaaacatgacactgctaaactgattaaggatttggaagcaaaagccagggaggaagctgacaagaaggccaaagattatgttgtaacggccattcagcgctgtgctgccgatcatgtggcagagacaacagtttccgtggtgcagctccccaacgatgagatgaagggacgtattatcggacgtgaaggacgtaatatccgtaccctcgagacactgacaggcgtagagcttattattgatgatacgccggaggcagtcgtactttccggatttgaaccgatcagaagagaagtggcaagaatcgctttggaacgtctgatcgtggacggccgaattcacccggccagaattgaggaaatggtagaaaaagcacagaaagaagtagagaccatggtgcgcgaagaaggagaggcagctcttctggaagtaggcatccatggaatccatccggaacttgtaaaacttctcggtaagatgaagttcagaacaagttatggacagaatgcactaaagcattcaatcgaagtagcccagctggcaggactgcttgccgcagaggtaggcgtagatgtccgcacggcaaaacgcgcaggtttattacatgatattggaaaagctgttgaccatgagcaggaaggtactcacgtagaattaggtgttgccctgtgcagaaagtacaaagagtcggcaacggtaatcaatgcggtagaggcccatcatggcgatgttgaaccgcagagccttattgcatgtctgatccaggctgctgatacgatttcagccgcaaggccgggtgcaagaagggaaactctggagacatatacgaaccggttgaaacagttggaggatatcacaaactcctataagggagtggacaagtccttcgcaatccaggcgggacgtgaagttcgcattatggtagtacccgagcaggtcagcgacgatgatatggtgctgatggctagggatatatcaaagaggatccaggaagaacttcagtatccaggccaaattaaggtcaatgtaattcgtgaatcaagagtcaccgattatgcgaagtaattattcagagtgagacaataaatgccccaaaccgtagaaaactagtatttgtgcggattggggcattttttattgatggcggtgacctgtgcgcggagcatgcaggttatcgtttaacaggagaattttcctgccgtaaaatctcaaaggaggataatatatggtaaaaattgaacagtcattatgtataggatgtgcgaaatgtgtgaaggattgtgtttcgggtgtattacatattgatcagggaaaagcggctgttagagagaattgtatgcagtgcgggcattgtgtggctgtatgtcccgttaaggcggtgtcaataccggaatatgatatggcggatgtggcggagtatgacaaggacagctttacctatacgccggaatgctttttaaacgcagtgaaattccgcaggagtatccgaagctacaaagatcgccgggtggagcgggaacagcttctgggactgatagaagcaggccggtatacggcaacggcggttaacacgcagagtgtgagctatgtgattgtacaggagaaacttgaggaatttaaagcatacgcatggaagggctggctgtcttacgcggatacgcttccctcagaacaggcagacttaaaagccgccatatataaattctatgaggcatatcaaaaggatcccaggcaggaccgcctgttttttaatgctccggtccttctggtaattgctactgagaattcctgggacggagggcttgccgcgcagaatattgagatgatggcagttgcagaggggcttggcgtactgtataacggttttatggtgcgggcagtccggcagaatccggaggctgccgaatggctgggactttcgggaaagaatgtctgctgctgtctgctgattgggtatccagatgtcgtttaccaaagaacggcccccagaaaaacagcggatgtcacctggaaataggttactgttatttaactgaggtttggaggacgcgttcggaatggatcgtgtccggtgtggtgaggggaccggctgagtcttccgtccccggttggaggttgtcgtgaggtgggaatccggccggaatgaattgctgcggggaccgtttgcactctttggagtgcgcaacagtgctaagctcgtgagggacctcgctaagcaccggcggactcccatgtcccctccgcaattgattccgcctacttccccggttcaggttttcgccggggacggaagactcaggcggaggttttcgcacaccggtcatggtccgctccgggcgctgattgtctccaaccttaaatgggaaagccttgtcgcagacattgatctgtgaacacgaacgaaaatagaccgtatgcaggcggaaggtcacagctttaccttgaatattgcaaaatagtgcggtattattaattagaaaaggttacagacagagaaatccggatatgggtaccggaaggcttatacgttttagagaggagattttcatgaggagaggcagggtatggtatacggcggctataacgcttgtgatgatgactggattatttacaatcacgtccttcgcggccaaaggagaaaaaataacagcgatcaagctggaagtcaaggataatttgcagcttggcagcgcgctggatgaagaggatgagctggagatagagacaagcgccgacagttacggcgtggcggagtgggagatcgataatgaaggttttacctggaattcagagcataagcctcgtgtgaaggtgaccgttaccgcagatgatgactattatttttccgtatctaaggataaagtaaagattaaaggagattcggcaaaggtggtttccacgaaaaaggaagactcccagacactgattattaccctcgatctgaagccgatggctgagagagtcggcccgattgagtacgcttatctgaatgggacggttgcaacatgggctcctgcacagggagcggtggcctatgagctttatctttaccgcgacagcaaagctgtggggagcaagaggacgaccaccgaaacaacgtatgatttcggaacagccatccgaaaagacggggagtactattataaagtgcgtgctgtgggcgccgaaggaagcaaagaaggaaaatacacggagtcggcaagccggtatgtcagcccttctgaggcgcaggccttggcaagtgccggcaacagcaaagcggcggacggcaacaacgggaataccccgggacagtgggtgcaggatgagaccggctggcgctggctcaatccggacggttcctatacggtgaataactgggcgtttatcaataataagtggtattatttcggcgaaaacagctatatggccacaggatggatacagtggaaggaactctggtattacctggggcctgacggagacatgcagacgaacttccagacaccggacggccacatggtgaacggcgacggcgtgcgtatttggtaatcagacaaattggaggacagaaatatggcaaaaatcggatttatcggaatgggcaacatgggatatgcgattctgaaaggattattaaaagtatacgggaaagaagagattatatttacggatgtcaatcccggcagatgccggcaggtttcagaggagactggagtttcctttgcggcctgcaatgcagaatgtgcagcctcggctaaatacatagtgcttgcagtcaaaccgcagttctttgctccggtgctttctgacatcgccggtacggtgacaaaagaccatattattatttccattgctcctggtatcacggtggacagcgtcagggaaactctgggagcagataagagaatcgtccgggccatgccgaacaccccggccctgctgggtgaaggaatgacaggcgtctgctatgacccggctcttttcgccaaagaggaacaggagacaatccggtcactgtttgaatccttcggaaaaatgcagacagtggaagagcgcctgatgaacgccgtagtatgcgtcagcggaagctcaccggcctatgtctatatgtttattgaagctctggcggacagcgcggtcaaatacggccttccgagagaggcagcttataagatggcggcccagtcagtcctgggaagcgctaaaatggtgcttgagacgggagagcatcccggagcgctgaaggataaggtatgctcgcccggaggtacgacaattgctgccgtatccgccctcgaggaatacggctttaggaacgccgtcatgaaggcctcggatgcatgctatgataaatgcacgaatttgaaataatgttagtattgttcacacggttgtattccgcgtgttatatatgaaaattcaatagacagaaggagcggcatgccatatgaaagagaaggaagaagaaacattttctgccgggtctgaagtgaggggagagaatatccccccggtgcaaaggctgaaaagagaacttaaatatcagggaactatcctgaaaatgtacgaggatacggttaatgtaaacggtcatgaagcaaaatgggatttcatccatcatgacggtgcggctgcagttgtggctgtcaaccatgacgggaaactccttatggtgcgccagtacaggaatgcactggaccgttatacgctggaaattccggcggggaagctggattatccgggagagcctatgattgactgcgcttacagggaactggaggaggagaccggatttaagacagagaaactggaatatctgctgagcctcaataccacgattgcattctgcgatgaggcgatcgatgtatttctggcaaggaacctgattccatccgaacagcatctggatcccgatgaggagatagaggtggaggaatgggagctgagtgatcttctggatttgatatattccggaaagatgacggacggaaagacagttgcctccattctggcatatgcatgccgtgtgaacagtaacggaagatagcagtagccgttcagatggcatacagtgatacaataaactgctgtgaatagagagacagaacgccgcatagactggaaaaaacgggaaaggttcttttgtatgggaaaatatcatacaccgtttcgttttcaaccgtccattctaacggtgttctgtttttttgccgggatatttgccggaaccatgtgggtaaacaggatgggggcaggtctcaaagagcagctgggagtattcggacaggcgtttctgacggggagtacgcagcctccttccctggagctgctggcggaactgctgcttaaaaggagccttggaatcggaattttatggcttctcgggatgtcattgtttgccgttcccggcttttgcctggcggccgtctacgccggtttttcgatggcatttcttatatcctcaatgacggtgcaggcggggctgatgggagtatttctcttcctgctttccgtattcccgcagatgatattttatcttccggtattggcggttctctacatatgggcgatggctccgggaaataaaattcacggcggaggctttgccgtccttcttattctgacggcagcaggggctgcgtctgaactgtggctgaatccctggttcctgcattttgcgtccggtttttaaggaaaataagaaaaaaattaaaaaatctttaaaaattttttaacaacatgtaggggaggcaaaaactgccttccaacatgttgtattttttatgttaatcagcctgaaaatactgtaaaagtgggaaaaatgtgtttgattttatcaaaaaatgtatatataatgttacgtacaggctgtttttggccttgttttggagggatgatgattgtccctgtaaaagcctgcaagggtgaatcgtaagggataggggaagcagtatggtaacagagatagatattttcataaaatacctgcaggaggtcaaaaagatgtcccggaacacggtgctgtcatatcaccgtgatcttcttcagatggcatcctatatgggggaaagaggaattacggaagctgggaaggtaacgaagaccagtctgacttcctatattctttttatggaaaaagaaggaaaggctaccactaccatatcgcgtatgctggcatccatgaaggcgttctttcactatgaattttcagagggtaaaatcagacgcaatcctgcagagcttgtccatgctccaaagattgaaaagaaagcgccggtgatactttccgtagaggaagttacgtcactgcttaagcagccttccgggcgctcttcaaaagagatccgggataaggcgatgctggaacttctctatgctacgggtatccgggtctcggaactgacgagtctcaagctgacggatatcaatatgaatatcggctttatcacctgccgcgacggcgggaaagacaggacaattcctttcagccgggtggcgaagggagcaatggaggattatatagagaatgcccgttcggagctgacgagaaaaaaagagtcggactggctgtttgtcaactgcaacggaggccagatgagccgccagggtttctggaagattatcaaattttacggcgataaggcgggaatcgaatcagacatcacaccgcatacgctgcggcactcatttgcggcacacctgataggagggggagctgatatgaaagccgtacaggtgatactggggcattcggatgtggctaccacacagatgtatgcggcatacgtgggaaaacggtaaatgtgtaataagtaaatggaagacgggtataaccgctttaaattatacaggtaaaacagacaggaaatcatgtcggacgcctctaaatcgaggtgcgcccgacatgatttcctgtctgttttacgtcatggtatatctatctgtttcatcataccataacggacctgacatccggttctcggagggggagcgtaacagtaaagagggagccttcatccggactgctctcaacggttatcgtaccgcccgacagttccagaatccgtttcgtaatcgaaagtcccaggccatttccgctacgtcccagctccctgcccgcgctgtaaaatttctcaaatatccgcctcatggtttcctcatccatcccgattcccgtatcggaaatcaccacctccacaaaatcaggaaaaagcttcatcgaagcggagatgctgcctcctgcaggcgtaaacttgatggcgttctgaaagaggttcagccagacctgcatcagcagatcgggattgccgaaatagcgcaccggcggcaggttgatatcgagatccagatatttattttcccacaggggttccagcatcagaagggactggcgtatctgctcatccagcttgaacagagtttttccggtcacgatttcctgcttttcaagccgtgacagcatgagaatgttgcctgccatcgaagagagctgcttggtactgtccatgataatgcggatatattcattcctgtcttcctcggtaagggaaggctcctgaagcagggtgacatatccttcgattgccgccagcggcgtcttaaactcatgtgaaatattcgttacaaagtcatttctgaacgattctatactgcccagttcctgcaccatcctgttaaaattgtcggtcagctccctcagttcgcgcagggatttaccggtctccaccttaatggaaaaatcgccctttgacacctgccttgcagcctggctgagattacccagggggacgagaaccttaaaccacaacaccagcgatatgataaaactgataaaaatactgctgagaaaaaatacaaggctcgggaacagcggattaaactgaagaaagcggatttttccctcctcgccgtttgcgatgagattcaccaggaaaccggccatcagcggcattacggacagtatgacaaaactgagtatcagcatataaaaccagtacttaggcaggtgaaagttcttttttttcataattctgctttcaccaccttatatccgagacctcgcacggtcataatcagaaaatcatcacagtcacgaaaacgctcccggagacggttaatatggacatccacggtacgttcgtccgaagtggagtccattccccatatctcgtccatgagctgctgtcttgtgaaaatcttattgggataggacatcagcttgtaaagaagatagaattctttctgcggaagcagcgtttcttccccatctacggtgacagtcagcgcatcataatcaagcgttgttttgccgcagatgatacggcggtccgtggcaattctggcccgtttcagcagggcgccgaccctcagaaccatctcattcacatcgatgggtttcaccatataatcgtcagtaccggcctgaaatccctcctgtttgtcttcaaaccgttctttggccgtaataatgagtatgggaaggctgtagccgttccccctcagcgtccggatcagctcataaccgtccattcccggcatcataatgtcggaaataattaaatcgatatattcggaatccagaagttcgagcgcctctctgccgccggatgccggaaccgtcaggtatccgctgcggttcagaacggtgcagaagagggaacgaagctttgcgtcgtcttctacgacaagaatatggaacatagatttatcctccgttcataatgtaaatcactgcttctaaaattcatatcacatctttatgaactaattataaacccaaagcgccatttttgaatttttcattcattatgcagaaggaacacaaaaaaatcacggtttgttaatatccagttaatgctcagtttaatttcgatttaaagaggggtggtatactcagttaaatttgaaacccgaggtgaagggaaattcccgcaccggtcatcgaggaggaccaagaatcatgataaaaggaagagtgaaagcattgataaaatcggccggaaaaaggaagaaattgacggcggaagccgtgacggtaatcgttctggcagcagcagcagcggcagcagccggaggaggtaaaaagaatgccatgccggcaggaatgatggggcagcagacgatgaacaatgtggcaaccgtgaaggctgtggcgcctcaaaccggaagtatcgaaaaaacgaccagccttgcggggaaggtggagccggcggatgtcgtatatgtttacgccaaggcgggaggtgacgtaacctcggttcttgtgaaagcaggtgatacggttcaggcaggccagcttctctgcacgattgatacggaacaggtggacagtgccaaaaactccatggatgcggcggcgatttccctgtcggaggcccaaagcacactgagcaggatgcagcttctctatcagggcggcgatatctccgaccaggaatgggagcagtaccagaacaatgtgaaaagtgcgaaactccagtacgagtcggcgaaactgtcctatgaaaagcaggtggagtacagctctgtcacagcgcccatcggagggaagatcgagagctgcgatttggaggtttatgaccgcgtaaaccagtcggatcagctatgcgttatctccggtcaggggaataagagggtttccttttacgtaaccgaaggcgttgtcaggaatctcagcctgggggacaaaatgaccgttgaaaaagaaggaaatgcttatgagggggtcataaacgatatcagcaccatggtggacgattcaaacggactgtttaaaataaaggcagacctggcgcaggccgattcggttgcaacgggaagcgtcgtcaaggtgaaggtgatttccgggcgttcggataatgtgatgacggtgccggtcgatgccatttactatgacggcggtgtgggaaatgtctatgtttatgaggacggcgccgttcacaaaaaagaagtggaggtggggctttatgattctgagcttgcggagataaggtccggactcgcggcggacgaactggtaatcagcacgtggagctcccagctctatgaaggttctacggtcaatcttaaatcggagggcggggaatccgctccggccggcaaagaaccgggaatgggcaggactgagacttctgcagcggcagaatagggcaggaggagataattaatgggaacaggaattacaaaatacgtccttaagcatccggtcaccacagtaatggcgcttctttgcctgattgtgtttggtatcacatccgttttctccgcaaagctggagcagatgccggatatggagacgccgatgctgattgtcagggccggctattccggcgcaggccctgaagatatatgcgagcttgtgacggagccgattgaagatgccatcagcacgctggaaggcgtgaaaaccatgagttccacatcgagtgacggaagtgccatggtaatgctggagtacgattacggaaccgatatggatgaggcctatgacaacctgaaaaagaagcttgagaatgccaaacggaaccttcccgacgatgtggacacctccatcatggagatgagcatgaatgccgggaccacgatgatgctttccataagccattccaggcaggaaaatctttatgactatgtggatcagaatatagtccccgaatttgagagaatatcatccgtagcggaggtcagcgccatgggcggttcttccgaatatataaaaatagagctgctgtccgaaaagctggagcagtacggtctgaccatgagcgacgtaacctcggccatcagcacggccaatctggcatatccctccggagaagccgtggcaggaaacctggaattgtctgtgacgacatccctggagacggagcaggtcggggaactgcaggatattccaattgctaccgccaccggagagctggttatgctgtcggatgtagccaatatctatgaggcaaaggaagacaggggaggcgtctcccgctataacggggaggagacgatatccctttccattactaagcagcagagcaatacggcaatggaggtttcgagtgcggtaaaaagcgtcatcgccacactggaagccggggacgaagacctgcacatcaacgtggcaaatgacacatcggagagcattctcgactcactgatggatgtagccgtcaccatggtgctggccgttatcatatccatgatagttatcttcctgtttttcggagattataaagcgtcactgattgtcggaagttccattccgacttccatactgatgtctctgattgcaattactgccgccggattctccctgaacgtcatcacgatgagtgctttggttctcggcgtcggaatgatggtggataactcgattgtggttttggaaagctgtttcagagcgacggccggaagcagggacaaaggaatactgggctacagcagggcggctcttgaggggacggcgcttgtgggtaattcaattatcggctccacgatcaccacctgcgttgtattcctgcccctggccggcattcagggcatgacagggcagatgtttaagccccttggctataccgttgtattctgtatggcggcatccctgttgtcggctgtgacaatcgtgccgctctgttatctgttctacaagccggcagaaacacaaaaggcggtgatgtccctgccgattgagcgttttcagagattctaccgacaggtcatggagaaattgttaaaacgtaagggtatggttatgctcgcatctgttgccattctggcggctaccgtctatctggcgtcggggatgcaggcagaactgatgacatccgatgatacgggaacggtcagcgtcagcattgagacgaggcccggcctcctgcaggaaaaagtaaatgatgccctggagcaggcggaggcagttgtggcggcggatgaaaatgtggattcctatatgctgcgtttcaacagcagcagcggcagcattacggcctatctgaaggataaaagaaaaatggatacggaagatgtggccgaactgtggcagaaaaaaatggacagcatagagaactgcaccatcgatgtatcggcctccacctcgatgagctttatgggcggtcagaggggatatgaagtgctgctgcacggtacccagtatgatgagctgaaagaggtaagcgataagattgtgaaggagatgacggagagggacgatattatcaacgtacactccagtatcgaaaataatgctccgatcgttacactgaaagtagatccggtcatggctaaggcccacggactgacggcttccgccatcggctccacggtcaaccagatgctgagcggtgtggaggcagccacgctcaaggtggacggtgaagaaatatccgtacaggtggaatatccggaggatgagtacaggactgtggatcaggttaaggatattatactgacggattcaaaaggccaaaaagttgcccttacccaggtggccgatgtcatattcaaagacagcccgtcctctatctcaaagacagacaaagcgtatgagattactatcagcggagattatacaggcggtaatacaaaagcggcaatcgacagtgaagtgatatcgcctaacctgacgggaactatcagcctgggaactaacagccgggacaggatgatgcaggaggagttcggctccctgtattcggcaatcgcctttgcagtgttccttgtgtttgtcgtcatggcaagccagtttgaatccgtaaaattttcggtgatggtcatgacgacgattccgttcagccttgtcggttccttcggtttcctgaagataacgggcgtcacaatcagtatgacaaccctgctcggtttcctgatcctgattggaactgtcgtaaataacggtatcctgtacgtggatacggtgaaccagtaccggcaggagatggatttacatacggccctggtagaggcgggcgctacgcgtatcaggccgatcctgatgaccagcctgacgacgatcctgtccatgatcccgatggccctggcaatcggaagcagcggttcaacaacccagggtatagcgattgtagatattggaggcctggcggtcggcgttatcgtggccctgtttatgctgccggtttattacggattgttgagccgtagaccgaaagaggaattccaggatattgattaaaatggttagattgcgacggatggttaataaaaacttgaggaaaggaaaaccggttatgcaaagcaataaaataaagacacggttttgtgttctggcggcgggaacagccataatctctttcgccgtcccgcaggcggcgcaggcggccagtccgccatttgcgtatacggaggaaaaatgggattccctgcgggacaataaactggaatatgatgagattggcgatttgatacatgaatacaacagcaccgttctcagcaaccaaattgcctatgaggattataaggggaaggacagcgacgaagtagcccggacctattatgatacagccgacgaaatttatgccggcattgagtatccggattcggatgatgccaactacggtacaagactggccgcggcacagagcagcgagcttcaggcggagcagatgatcgacaggggagacgaaaatgtcaccgacggcgatgtggtgaaatggggttatgataagacggaaaaatcacttgtccagtctgcccagattcttatgattacttactggaaatcgcaggcttcgctggacagcagcagaaacgctaaaacaacagcagaaaaatcatatgagacgacacggcttcaggcagcggcgggaacagcggcgcagtctgccgtcctcagcgccagggatgcggttatgcaggcggaagcggccattacatcggctgaaagcgcggttgcatcggcaaaggagaatctctgtctgatgttgggatggaaatatggggacgaggttgagataggagaactgccggagccggagcctgcgatgagcagctctgtcaatctcgacgaggatctggtaaaggcagttgaaaacaattatgacatcaaaattttatcgaggcagataaagaatgccaggcagggcgccacgcagcggcagtacgaggaaacgttaaaaagcagtgaggaggcggtaaaggccaatgtgaaatcagcctggcagagtctcctgctggcagaaacccagtatgcccagactgtaaaaagctttgagctggaggaaaagaccatgcaggcggccgaacgcaaaagagcggccgggactatgagcctgaatgaatatcagagccggcagatatcttataacaatgctgtaacggagaaagaaacggctgccatgacattattggaggcgcagcagtcttaccgctgggcagtggacggtctggcatcgacagtataaggaggaggcagaatggagattcgcaaaatcgcaggctgggcggcggcggcagcaactgctttcagcctcctgtatcagtttccggctaaggcgtccggcccgctgatatcaggacttcaagaaccgggggaggctgagggcccggcgttagccggtaatgaagaggaggagataaaaaccgttaccgcatcaatcagtgaggaaaatctgaatgacggcctgattgaatatgaagagctggaatcacttatccggaccggcaacagcagtgccgtcaactcgcagaagagctatgaaaccaggctggaggtttaccaggctgcatacgattctctggtaagcgccaaacgggatatgttaaataaagccgatgaactggaggatgagggcgcggatgcggccctgattgaaagttatgaacagaatgcacagattctgtcctcatcggctgctcagatgaagagaagcatcaattccctcaattccgccacaaaccaggcatccctggaccggacaatcaacagtctcgtaaaatcggcgcagacgctgatgtactcatttaagaagatggagtaccaggtaagggcagccgaaaagagggcggaggctcaaaatgccgcctatgaactggcgtcagccaggagacaggcaggccttattacagaaacagagcttctggattctgagaaaagtctgttaaatgcccaggcatccctgcagtctgtccgggacagtgcagataagctgaaacgccagcttgccattctgatcggcagagatgctgaaacggttcagattggggaaattccggccgtgacatccagggagcttgaacagatgaacctggaaagcgataaagcgaaagcggtaattgcagatcccgaagtcaaatcaatcaagaagagcacagcgaccggagacactgcccgaaagctgagaagacagcagctatatgaggcggaaggagcggccggtctgacaatggatgaattgtaccgggctgtaatagaagcgcagcagctttatgagggagccggcgcctcctatgcggctgcagaaaaagattacggtgcggttaagacaaaatacggggccggtatgataaataaaagcacttggctgtccggagaagcggaatggtattcggccgcagccgcctataaaagtgctgaaattgcctataagcaggcggtggcttcataccagtgggccattaagggaattagctgataagctaagtctgcggcgggtcgctgtggcggcattattccctgccgctgcagtgcgatcctccgcggagcggtttttatttaacaggagacatttcctgttaaaccaaaaagaaccggcagattattctgtcggttctttcactatggatacaaaactttttttcagaactttggaagcctcagcgcatgctttatattccctggaagtcgtgtcttccagaaattcgtcataccatgattccaatatgtaggtcttattgccataaaaaccaaggatggaacaacctttcaaatcctgataatcgacatcttcataacagatgatggaaaagaggaggccggagccgtcttcttcatatgcagtcttattataaatctcataactggaaccgtcggctaccataacacagttacccgaccaaccgtccggcattttaaaagaaaaatcgtctgtaataacctttgaaccggtaagttcaatggcagcatcggtatcaacgctatgaccgaagcttacaacctgggcagtatgttcagcaccgaatgcggtgacagagaatgtcagcgccaacagtgcggtacagataatagtcctgaatcgcatccttcaaccctccgtatttgtcgccatgaaaacgggacatagtagatatctccgtccattctatcatgccttaagaaaaatgtcagcaaaaaattggaagaatgtaagtaaaaagttaccgattcaggaagcatcggtaaaaagggggcagtgaaaaacgattattacgttttcactgcctcctctttgaagacggtgagatgttctgtcatgaaacatcttcctttgtattaagatttttctgggccgttgccagcatcagcttgatacggttgagctgatttacctcactggcgccgggatcatagtcgatggcgataatattggcttccgggtggctgctccgcagttccttgataactcctttgcccacaatatgattcgggagacagccaaacggctgggtgcagataatattagttgtaccgctcttaataagttcaagcatctctccggtcaggaaccagccttcgcctgtctgattaccgatggatacgtaatgttctgccatggatgccagatcattgattttggcagggggcaggaagtggacgctccgttccagttctttcctggaggtcctgcggaaatattcgagcagcgaaatgcccatattgcaaagatatgcggtagagcgctttccgcccaggttatctgctttaaagttgctgttgtagaagcagtagagcaggaagtccagcagatccggcattacggcctctgcgccctctgcctccagcagttccactacatggttattggcaagaggggagaacttcacaagaatttcaccgacaattcccacctttggtttcgttacatttttccgcgggagttcatcgaaatctttgataatgccccggatgtttctgttaaattcaagcatcgtcggtgcgcgccgcgacagtgatttctggcagatgtccctccatttgccgtggagcgcattggcagaaccgggttttgcctcatatggccttgtagcatacaggacacgcatgaagagatccccgtataccacggcctgcattgcttttgttatcagaggcagcgtaatcttaaagcccggattcgtctccataccgttggcattgagcgagataacgggaatctgtggcatcccggcccgctccagcgcgcgtctgataaatccgatatagttggatgcacggcagccaccgccggtctggctcatgataatggccgtacggtttaaatcgtatttgccggaaagcagggcatccatgatctggcccactacaatcagggatggatagcaggcatcgttattaacgtatttcagtccggtatcgacggccctgcggtcggagttctgcagaacctccagcttgtagccgaaacttctgaccgccgtctcaatcagttcaaaatggattggagacatctgcgggcagagaatcgtataatccttcttcatttccttcgtgaagaagacgcggctgtacgcgtttgatacgacaggtttacggtagtgcttcatctcccttacacgaattgccgaaatcagggaacgcacacggattctggcagctcccagattgttgacttcatcaattttgagcagggtgtaaattttgccggaacgggttaatatttcatttacctggtccgtagtcacggcatccagtccgcagccaaaggaattaagctgaatcaaatccagatttggctgtgactttacaaagcaggcggcttcatacagtctggagtggtacatccactggtctgtgacaattaaaggacgctccacctttcccagatgtgaaacggcatcctctgtcagtacggcaaagccgtaggaagtgataagctccggtatgccgtggttaatttcgggatccacgtgatatggacggccggcgaggacaattccgtgtctgcctgtttccttcagccatttcagggtttcttcgccctttttctccatatctttccgggatgcaatcagttccttccagccttcccctgcagccatgcgtacttcttcttccgggatggaaaagtcttcacggaatacttccaccagacgttttgtcaggatttcctcatcggtaaaagccataaaaggattgctgaattttactttatgttcggtaagctcctcgacgttattcttgatgttttcagcgtaggaggtgaccatcgggcagttaaaatgatttcctgcgtcgggggactcattgcgctcatacggaatgcaggggtaaaatatgtattcaatgccctgctttatcagccactggatatgcccgtgtaccagttttgcagggtaacactcggattcactcggtatggtttcaattcccagctcgtaaatcttccttgtggactggggggacaggacggtcctgaaccccagttttttaaagaaaacagcccagaacggataattctcatacatattgagaacacgcgggattcccacggttcccctcggggccatatcggccgtcagtggttcaaaatcgaacattctgtggtatttatattcaaaaagattgggaacatcacgtttggccctcgtgcctccgagaccgcgctcacaccggttgccggttacaaactgacggccgccgtcgaagcggttgatggtgagcacacagtgattggtacagccctggcatctggccatgttcgtttcataggtgaggcccaggatcttgtcgattgagagcatcgtggtagtcttagaaccgtcgtagcgctccctggcaatcagtgctgcgccgaatgcgcccatgataccggctatatcgggccgtacggcttcacagccggcgattttctcaaagcttctgaggacggcgtcattgtaaaaagtgcctccctgaacgaccacatggtgtccaaggtcttcagcgcttgtgattttaattactttaaacaatgcgttcttaatgacggaataggcgagaccggcggaaatatcggagacggtggctccttccttctgggcctgctttacattggaattcatgaaaacagtacatctcgttccaaggtcggtaggatttttggcaaacagagcctctttggcaaaatcgataacgctgtagttcagggattttgcaaaagtctcaatgaaagaaccgcagccggaggagcaggcttcgttaagctgtacgctgtcgacggtgccgtctttaatcttgatgcacttcatatcctgtccgccgatatccagaatgcagtccacatccggttcaaaggccgccgccgcataatagtgggagatggtttcaacctcgccctcatccagcatcagcgccgctttcagcagcgcctcaccgtagccggtggaacaggagtatacgatattggccttttcgggaatgacatcgtgtatctccttcattgcgcggattgcggtagccagcggactgccgttattattgctgtaaaaatggtacagcagggctccgtcttcgctgacaagcgccacctttgtagtggtggaaccggcgtcgatgcccagatagcagtttccctcataagtggagatatccgctttcctgacattgtggctttcgtggcgtctggtaaattcggcgtaagcctcttcattttcaaagagaggttccatcctgttaacctcaaaatccatcttaatgccgtgggagaggcgttccatcaggctctccagactggcggtcactttaccctctgaattcatggcagcgcctacagcggcaaagagatgggagtgcgacggagcgataatctgctcatcccccagattcaatgtcctgataaaggatgcacgaagctctgacaggaaatgcagcggccctcccaggaaagccacattgccgcggatcggcttcccacaggccagcccgctgattgtctggttcacaaccgcctggaatatagaggcggaaaggtcttctttcgttgcgccctcgttgataaggggctggatatccgattttgcaaatacaccgcagcgcgcggcgatcgggtagattgatttatagtttttcgcgtattcgttcagtccggatgcgtctgtctgaagcagggaggccatttggtcaataaaagagccggtccccccggcgcagattccgttcatccgctgatcgataccaccggtgaaataaataattttagcatcttctccgccgagttcgatggcgacatcggtctggggagcaaagtcttttaatgatgtggctacggcaactacctcctggacaaaaggaatgcccagatgtttggaaagagtcagtccgccggaaccggtaatcattggttccacatccagattacccagttgaccggcaccttttttcagcagtgcggagagggtctcctggatattggcaaaatgacgctcataatctgcaaacaggatattgcctgcgtcgtcaataatggaaatcttaacagtggtggaaccgatatcgattcctaatcttttcttagaattcatgatcagtcggggcttaccccttccctcctttgtattacacatgtattcggcctaagtttaacatagaataggaaagaaaacaattgatccgatgcgttaaaaagccgctaagaatcatgtgattccgttaatattgcccattgatccggggggaagaaaaggatgttaaaatcatgttaagaagaggttaatctggggtggaaatggagatttaactgaggtgtggaggacgcgtccggaacggaccatgtccggtgtggtgagggggatgactgagtcttccgtccccggttggaggttgttgttagggggggaatccggccggaatgaattgctgcggggaccgtttgcactctttggagtgcgcagcagtgctaagctcgtgagggacctcgccaagcaccggcggactcccatgtccccctccgcaattgattccgcctacttccccgggtcaggttatcgcagggacggaagactcaggcggaggttttcgcggcaccggacatggtccgttccgggcgctgattgtctccaaccttaaatggagagggccctgtcgcgaccactacgtgtttctgcaggcagataccaaatctagcgccttttataaaggcgcaatgaaggcatatcgtatttcccgtacacggtagcactgagtggccgcgacaaggtccgcccccgcacttaacgcgtgagacaatcagcggccgcaggccggcggacggggccgatacacttggcggagtctttcgttccggcgaaaaccttccgggagaaggagatactgccgacatcttccggcggagaaggagagaatgatattcggaaggacgttcgcccgagagatgatagctcttaggcagagggagacaaagcgcgccgggcggattttagacctacaaggtcaaaatccgggacaacttgagcttcgaactcattcggagttcggagcgaatttgtccgtaaccccggggggctttgccttcctctgtcttagagctatccctcgaagaagcagtccagccggatatcattctctccggctccgccctgcgaaaacaaaaccacagtatctccttctccatccagcgatgccaaacctccgggacgaaagactcatatacacaccccgccaccccgtccgctggccgttccggcggcgtcctcacctgcttaactaaatctctatttgacaaagacgcccaggatatctataattaaaattcaaaggccttttagcggcctttaaatgtaagagaaggatgtgaattatgaacttttttagaaatctggaatataaatacggaaagtatgcgatccgcaatctgatgtattatattatcatgatgtatctggcgggaatcctgctgaatctgattaacccgatgttctattatctgtatctgtcgctggacgctaaggcaattctgagcggccagatatggagagtcgtgacatttttgatttgtcctccggcgtcggggattttgtttaacctgattgccatgtacctgtactattccctgggtacgacacttgagcgaacatggggagcgttccggtttaacgtatactttttcatgggtgtactcggacatattctggctgcgtttatcatttactttgtaacggggacttcctatccgctgacaacgtattatctgaatgaatcgctgcttctggcctttgccgtcacattcccggagcttcagttctggctgatgggaattctgccgattaaggcaaaatggctgggaatcttcatcggcgcgcagttcctttatgacttcttctttggcggagtagtttcgaagataggtatcggcctctccatgctcaatttcgtgattttcttcctgatgacaagaaactacagacaggttaatccgaaggaagtaaagagaaaacaggaatttaagtcacagatgaaaaaggctgaggttcagaagattcttctgacacaccacaagtgtgctgtctgcggaagaacggaaaaggatgatccgaacctggaattccgattctgctccaagtgtgcgggcggccttgagtattgtatggatcatttatatactcataagcatgtcagcgaggaagatttaaaggaaatgaggcaataatagcaatacacagtacgtgagaaacatgcaaaccggtgacaggaggaagattgaccgatgaagaaaactaagattatctgtacgatggggccaaataccaacgatagggagattatgaaacagctcgctttgaatggtatggatgtagccagatttaacttctcgcatggggactacgaggagcatatgggccgttttaaaattcttgagagcgtcagggaagaactggagcttccgattgcggcgctcctcgataccaaaggaccggagattcgtacgggaaagctgaaggatgggaaaaaggttattttacaggagggtgaaacatatattctcacgacggaagagataattggggatgataagagaggatatattaattatcagggacttgccgaggatgtgaaaaaaggcgacaaaatcctgattgacgacggattgattgaactcgatgtggccgagataaagggacgggaaattgtctgtaagatagctaacggcggtgagctgggagagcagaagggcgttaacgttcccaatgtcaaaatcaaacttccggcgctgaccgacaaggataaagatgatatccggtttggaattgaggctggatttgacttcgtcgccgcttcttttgtacgaaatgcagatgccatcagagaaatcaggcagattatagaagaaggcggttccacgatgcagatcatagccaagatcgagaatgcggaggggatcgagaatgtggatgagattattgaagccagcgacggcgtgatggtggcccgcggcgatatgggcgttgagataccggcagagaaggttccctatatccaaaaaatgctgatccgcaaatgcaacgaggcatgcaaggtggttattacggccacccagatgctggattccatgatacgcaacccgaggccgaccagggcggaagttacggatgtggccaatgccgtttatgacggaaccgatgcggtgatgctgtccggtgaaacggcgatggggcattacccggttgaggcggtcagaatgatgagccagatcgtggaggattcggaaaaacatctggattatctctcctaccagaagagaaaagtcagcgccgagaatgtaaggaacatttccaacgcagtctgctattcttccgtatcgacagcgcatgatctgggggcaaaggtgattgtcgctccaagtatcagcggttttaccaccagaatgctttccaagtggcgtcctaatgcgcttatagccgggctttcaccaagtatgtcggccgtgagacagatgcagctttactggggggtaaaaccataccatgcaaagcgcgccgaatcgacagacgttttgatttactcctctgttgaactgctgaaggagaaaaaggttgtaaaaacgggagatattgttgtggcaacggcaggcgtggtgacatatgccaaccgccactcaccggcagccgatacaaatattatgcgtgttgttgaggtagactgatacggtaccgatgttacagtccagccttcggctaaaccgtaacaaatgatgcacagaaacggcaaaaaaacgccgtttcgcgccgcacaactcgggattttcgaaaaaaacagcgaaaacacctcgcggaatacatcatggctgaactgttacgtaccgatacggcgcggtgataagaaatattgagatttttgtaagattaccggttgattaatctgcaaaattagtgtataaataatctacaggacaatggagtctggcccgaattcaggaaaagcagtttccggaagcggttcaggctctttttatacaaagggaggaatatggaatggagaagaaaccatttgtcacattagagaagcttaaggaaattaatgagacttatccaaccccgtaccatctttacgatgaaaaggggattcgggagaatgcggagcgtttaaacaaggcatttgcgtggaacaagggattcagagagtattttgccgtgaaggccacccccaatccatttatcattgatatattgaaaaagacaggaagcggcgcggactgttcctcacttacagagcttatgatggcaaaggctatgaaattcgaaggggagaagatcatgttttcctcgaatgatacgccgccggaagaatttaagctggcagatgagctgggagccatcatcaatctcgatgactttacccatatcgattttttggagaagaccataggacatattccggagacaatcagctgccgttataatccgggcggcctgttcaaaatcagcaatgatatcatggacaatccgggcgattccaaatacggcatgacaacggaacagcttttcgaagcatttaaggtgctgaaggcaaaaggagcgaagtattttggaatccatgcatttttggccagcaatacggtgacgaacgaatattatccgatgctcgcaaagattctgtttgaggtggccgtaaagctgaaagaggagaccggggcagatatccgctttattaatttgtcaggaggggtgggaatcccataccgtccgggccaggagccgaatgatatttttgcaataggcgaaggtgtaaggaaggtctacgaggaagtgctggtaccggcaggaatgggagaggtggcactttacacagagctgggccgctatatgctggggccttacgggtgtcttgtaacgactgccattcatgagaaacatacacataaagagtatatcggcgtagatgcctgtgccgtcaatctgatgcgcccggccatgtacggcgcttatcaccatattactgtaatgggaaaagaggacaggccgtgtgatcataagtatgatgtggcgggctccctctgtgaaaacaacgataaatttgcgattgacaggatgctgccgaaggtggatatcggcgatattcttgtaattcatgatacgggagcgcacgggttttccatgggatataattacaacggaaaactgaaatcagcagaattattgctgaaagaggacggctcggtgcagatgatcagacgggcggagacgccggaggattactttgccaccttcgacttctgtgacatgttcaaaaagggctgatttatgtgctgattctgctataatgcaaaaagaggcatttttattgcagtcaaaagtgcaatattaagaaagtcttcataatttattcaaagactatacaaacattttccggagaagcgtgctatactataaacataataaatgcacgatacaaatgaattaaatcctttaacctttttgaaatccgaattcctaatgatttagccctgtgccaacggcacagggttttttcattccaggatataagagagagtgcaagaatgcgatatctttgcataaacggtttatcacagaagaagcagtttatacagcctccggtaatcaatgggctttgcaacatgatcgttcattccggctgtcagtgcctttgtaacatcctccgcaaacgcattggccgtcagggcgattatcataatatccgcggcctggggatgatgactggaacgtattttgcgcgcagcggtgtaaccgtccatgacgggcatctgtaaatccataaggatggcaaagtaggttcccggttctgaatccagaaaacgccggtacgcctcctctccgttgacggctccgtccacagtgaagccggcatcaccaagaattgtctgtgctatctccatattcagttcgttatcttccgccagcaacaggcgcctgcctgccgctgccttccggatttcctggatacagtcacagaggttgtccggctggtctgaggatgggccggattttaacagaagggctgcttcctgttccaataatttcaagtggagggtgacggtaaaacggctgcctttgcccggctcactctccacctgtatattaccctgcatggctgtaacgattcccagtgcaatgggcataccgagtccggttccctggatatggcaggctttggcgtcctctgcccgggaaaaagggacaaatatgtaatctaaaaagtcttttgacattccgattcctgtatcagcgaccgtgaaaacaaggcagccgtatccttgaagatgggaggaaacctcctgtacggcgatgtcgattctgcctccgtcaggagtatacttgatggcatttgtgatcaggttaattaacacctgacggattctcccggcgtctccgcacaaatggtcgtggggtgacttaggattatggaagcacagctcctgcttctttgcgcaggcctgaggagagagaatcgattccacatctcccagcagctctttcagggagaagggagcctctgccagttcaagctttcctttttctattttggacatgtccagaacatcattaatcaattcaatgaggtgatggctggagagcgttatttttttcaggcagtcccttaccttttcgggatcttcggcctgagacagggcgatggaggacatgccggtgatggcgttcagcggagttctgatatcatgggacatctgggcaaggaaattgctcttcgcctcattggcctgtttggctgcctcatatgccgccagcagcgctttgcggttgcgctcctcctgctctttctcttcctcgacgctgtgggctgccaatatcaccttcacaggcactccattgcggctttccgcaagaataatatgcatccgcatccatccataggcaccgccgtaatttctgcggtattcaagagcataaatcatatcgccccccgtaattcttctgcggatgtcgcaagccgacagctcttccataaaccgtttccgatcttcctcatgaatgaaacagctataaaccgttttcagatattcatagtccgtactgctgccgagacggcaggccagatcgtccatcagattaaatggctggaatgattctgtgagcaggtcgatgtagaatacggagtgataaaaaaccgacaggcccctgataatattctgcgattcaaaatacagccttttttgctgctgttcctccagctctttcatcttttgttcatgtatctgcatattggcaaaaatgactttacttacacggccgccttttatttccgcaatactaaagcgtgaacggacccagataaggccctccgggtaaatccttctgaaatcaatgtcatagaccggatgctgcgcagacaatgtgtttcgcagaaaatccgggcttccggcgcggcgcattttttccttgtcctcgctgaagacatgatcgcggataaatttatcatagtaagtactgagactgcctttgggaaattcccggctttcccggataaactcttcctgccagactgactcctccatatcgttgtccaaatcaaacaggtagatggaatagtagcattggcacagtgtcgaaagcacatcttcccgcatctgcgcctgctgcctgtcgtcctgttcgtcgaaggcggcgataacgaaggggtgtttggaggaatatccgtcaatcggcaggagcttgatacgtctccatccgccgaatatgtctctgaagatgatttcgatctgcttttctccgtcagacagccttttggaaataagcttcgtatccgccaaaccgagcaggaggtggcggtagggaacggccacctcttcggcagagtagacacggaaaaagtctccaaattttgtatatttgagggagagctcctgaaggcgtcctgaaacttttatggccttgtagctctggtcatccagattgcaaaggaaaattccggtataactttcgcccagagtctggataatgatatcatattcttttttcagcataaaggtattggtaatattctgatgatatcccctcagacagacgccctcagtatagctaaagtcgcgtttaccgccacagcgtataaaaatctctccccattttggatggtgccaggtatactgtacctcggcgcggccatcggaagtgattcgttccacggcagactgcacaaaatcgtaatagtcggcgtcaatacggtcataccagacgcggtaacactcctcgggagccggttccgtactgaaacccagcagttccagcattgtatgatccgcatacatccgcggctcttttccttcgttaagttctaaaacccagagccccatttgagcttcatggaggagttcctgtattttctgcgtatctttaaaatgatccggcatttatcgattcctttctataaaaaagaatagtatgcttccgccgggagaggagcttaagtccgctgcggcggaatattcatgaatattttacatatatatttctattctatggtaaaagtgtgggcgatgcaagaaaaaaatggctgctgtacctttaaattgcaggacagcagccgaagcttatatttttacggaaaatttgtagcccagcccccagactgttttcagataccgggggtttttgggatcttcttctatcttgtttctgagatgacttatgtaaaccataatcgtattggcatccacgacggagccgttccagacatgctcatagagctgttcttttgtgaagacacggccggcattgcacagaaacagcttcattaaaacattctctctggatgagagaggaatcggccggttatctttaaagagttccattgtcatactgttatagcaaaacgggccggccgtgataaaatcagggagcggcctggaagctttcatgtccctgcggatgagtgctttcattttagcgcccagcaccaccggattaaagggctttccgatataatcgtcggctccgatatcgaggccgtacaaggtatcgaaatcctccgtacggccgctcagaacgatgattggtatctcattcccggaggccctcaggcggcggattacttcaaacccttcatcatttccattcatcataatatccagcaggatcagattaatcttgctgtcacggctcatgacgattgcctcatgtccgttggaagcggtaagagactcatagccgcagctggcagccacccgtgtcagcagcttgcgtatcgcaggctcatcgtctacaatcaaaacagtaccgtctgacataataatccacctttctttttcaatgcgtatcttcattatagaaaaaaacatgaaaagataccgttaatttcccgctaagactgccaaaattgactaaaatgtgaacgtttcttaagactttttcatgagatattaagaagagcagaataaaatggggtatgactgaaagccaatgggcaagaaatcaaaagaagtcgataaaaaaaggaggagtatgttatgtctttagcttttctggggtttgccatgatcgttgtgtttatggcgctgattatggcaaaaaaattaagtccgttcacatcattgatactggtgccgattgccttcggactgctggccggttatggatgggatacgcttaagtatgccatggacggaatcaaaagtgttgcatccacattttcaatgatgacgtttgcaatcctgtatttcggggttatgctcaccgccggtatgtttgatccgatggttgacaaagtagttgcctggtgcaaaggcgatccgctgaaggttctggtgggaaccgctgttcttgccgctttcgtttccctggacggagacggaacaacaaccgtcatgatctgctgtacggccatgattccgatttacaacaggctgaaaattaaaaagatttatcttgcaaacctgattattcttcagaattgtattatgaacctgattccttggggaggcccgacggcccgtgttatgtccgttatgaatctggacgccggtgagctcctggctccgcttgtacctggaatggccctgtcggcagtctatgtaataggagtttcctactatctgggactgaaagagcgcaaaaggctcgggattatggatatcagcaactcggtaaacacagtggagctctctgacgaggagagggagtggaaacgtccgaagatgattctgttcaacctgcttctcacggttgcaatcatcacgtccctgattatgggtctggcatcctccgccattctgtttggtgtaggtaccgcaatcgcactggtggttaattacccggtgcagaaaacacagagaaaggtaatcagctcgctcgcacccgacatgatcagcgttgtcatgatggttctgggagccggagttctcatgggagttctgaacggacctgaagatgccggcatgtcaaatgctattgcacagttccttgtatcggtaattccggaatctctgggacgttattttgcagtgattattgccgtgatcagtgcgcccggtacataccttctgaataatgacgccttctattacggtgttctgccgcctctggcagcgacggctcaggcctatggctttacggatctccagattggttttgctgccctgatgggtcaggccttccatttcctcagcccgctggtgccgtttatttacctgctgatggatctgacagaaatatcgctggccgagtaccagggctatattttcaaatggtgtatcggaatatttgtaatatttatgggagccgggcttctgctcggatatcttccggtgttataacagttagggtttataaaataaaaaacaatgccatattacagttttaattgactgcaatatggcattgtttatttaatttaacaggaaagttctcctgttaaattaaaaccgctccgcaaaggatcgcaactctaaagagggcttgttcactaagctcgttacactcgctaagtgatccaatgcctgcggcggcaggagcttaccgctggtgcggcaggttcttttcaattggaatcacgctgggcatggacgccacaaatttttttgtttcctcgataaacatgcggacggcctttgcaccggagggattggcttctctctgggtcacgagatagattgtccgggcgggcagctccggttcgggtgatgagatgacaatatttccgtcgcggttaatcatctccgccacacagagcgggacagcagcccatgcacgttctgactggagaaaaaactcaatcagggtcggagtgtcgacagtgacctttggttttgtgataggactccagtttcggttatgccagatttcaaattccacgcccaggtcaatataagtttcgtcctccacggacagcgactccacttttataatatccggataggaggagtagcgccggtcactgaccagaaccatcggctcacagaaaataggcgaagtgacaagattcctggatggaaacggccgggatacaaagccgatatccaggaggtaattgtccataagattataaatggtattgttccagtgggtgctgattgtaagtctcagctggctgctgccggagaaacggctgtaaaggccggtaaataaaaaagaattgatgctgtgcggcgctgaaaccttcagttcatagcaggacaagttctccttccaggttttaatatctttttccacctccagataacggctggccagggtaaggaattcgttgcctttcggagttaaggtcactcctttgattccggggcgccggttcacgagaggacttccgatttctgactccagattggtcaggcggctgctgattgtagattgggatacaaacagtttatcggcagctttagacaggttcctggtctcggtgatagccagaaaagcctcaatttcaagggggttcatacagcacttcctttctttaaatatcgaaaaagccgatgattatgaacaggttttaatattttacatcagaaaaagccgatgttataattcttatacaagttataaattttattaaatattatcagaaaaaaaacctccttgcaaggaaaaattcaacatttgcttcggccggagcatatgcaaaaaagaatcaaagaatgtggtgacagaaaagaacgattcagatgtaatttaggaggaagaaaatgaaacaggcggatttagtaatcaaaaatgcaaagatttatacaaacgggactttttttcaaggcgctgtggcagtcagggacggaatgattgccagcgtatgcacggacagtgaaatacctgaggcggagaaagtgatagacgcagagggaaagtacctgcttcctgggatgatagagtcccatatgcatgttagagaaccgggcagaccggacagaggaaccttctttacggagacgaaggcggctgccgccggaggcgttacgacgatcctggaacatccgattgcaaaaccgccgcagtattccaaggagattctggagagaagaattagtgatgcctcggacaaatgtgtcgtggattttgctttctttggtgcggccggttcaaagtatcccgataaaatcagagaaatgggggagacgggaattgtcgctttcaaaaccttcctccatgatgcgccggagggaagggacgaggaattcatggggcttacgatggcaaatgacggggagatgtattttggcttccgcgaagtggccaagacgggtaagctgtgtgcggtacatgcggaaaacaatgatattatttcgaaaatgataaaggaattcagaaaagagggaaaagtgtccccgatttaccattgcctgtcccgccccaaatttgcggaatatgagacagtcggaaagctgctgatgattgcaaaggactgcggtgtgaagctgatattctgccacatgtcgactcctgaatccatggagcttatcaaatcggcaaaacaggaggggctggaggtttatatggaaacatgtccccagtatctgttcctgaccgaggaagatgtggtaaagcatggcgcctatgcgaaatgcaatccgcctcttagaaaaaaagaagacgtggatgcattatgggattatgtaagagacggttccgttgattttataggaagtgatcatgcgacttatacggttgcggaaaaagaaagcggaaaagatgatatatttgtggctccatccggtttcctcggcgtggatctccgtcttcccctgatgctcaacgcagtcaatgaaaagaggttatcgatggaacgcgcagttgatctcatgagtacgaatgtggcaaaatcatttggcctgtatccgaaaaagggtgtgataagcgccggcgcggatgccgactttgtaatggtggacatggatgaggtatttacggtaaataagaatcaaaattactcacagtccagggaaattgccaaagtgtatgacggctggagactgaagggaaagccggtgatgaccgttgtcagagggcgcgtggttatggaaaacgggattgtggatgaggagagcaagggctggggacacctgctcgaaacatatatagaaaaaaatgaggaggaaaagggatgattccagattttataccggcagatttgaagattttttggctcttttttggatttctcagcctgcttccaatgattttggcttatattacgcagaaacgggatgacagacggaacaagtagagtgatattcggaggagttattggaggaggtatttatggtttatgtgataattctgctgctttatctggcggcactgatttttgttgggaagcttgcgtcacgcggagtatcaagcagcgatgactgggcagtggcggggaggagccttggagtctggtccagcgcggcttcatattttacgacggtattgagtgcggtatcttttatcgggtatatggggtattactatcagttcggatggggaggctggtggaactgggcaggaaccttaatctgtacgatactgtttgccggattttttgcagcccgtctcaggcggtttggcggtgtcacaatttccgatttcctggacagacggtttggaaaggcccatggggcgatagccgcagttctaattttattttcaaccgttctgtttaccatggcccagctggttgcatcggcctccattattaaggtgatcacagggattccggagtatctgtccgtgataattgtggggatcgtgtttctggcctttacggtgacgggcgggatgaaatcagttgcatggaccagtgttttgacatccgttttgattctttttggagcatatgcgctgatgattgccattctcggtaagacaggcggattctgggaattgcaccggttagcttacacggaggacccggcgcttctggatccttttgccggcggaagtatcggcgcaggactggcgctttcatggtgtgtgacctgggggattggtaatttcgggctgccgcagcttattacaaagtttaattcctgtaaagacgaaaaaacggcgcgttacagccagggaatttcgggcatactttttgttcttttttatcttccgcttatggtaattggcctgggaatgagaatcctccggccgggcattgtacagacagatacggtggcttcaattgcaatggtagaaatggtgagtcctctgatagggggaatcgtgctggccgccatcctgggtgccgccatatccacggcagcctccgtccttttacaggcgggaaccacggcaaccagggatatctatcagaaatttatcaatccgaatgcagagggggagcgggtactggcgatatcaaaaggaacgacattgacggttgggataatatcgatagtattgtcactgtttaattcttccaccgttctgatgattcagtcaaatatggtgggcgttctcggctcgatgcttgctatgacgatcattatcggatttacctggaaacggtcaaacgcccagggggggatggccggtatgctggctggtatcctgacggcagtaatatggtatgtactgaaacagccatttggatggatgccaattcttccggccattttcacgtcgacggcagccaatatattagtaagtctgatgactccggcgccgcccaaagagacagtggatgaattttttggaaaaaaggacagaatagaggagccgaagaagaaatttgcagatgctgcaggaacaggaggagaaacatgcggacagatgtgaatatggaacgtctgatggaaagccttcaccggacgggggatatcggaaaaacagagaatggggggatcacccgcccgggctttagcagggaatatgagatggcgtctaaagaattaatcgcaatgatgaaagaagccggtcttacggtttcaaaagaccgggtgggcaatattatcggacgcagagagggaagcaggagcggggctttgtcgattatgacaggttcccatcttgatacggtaacggaaggcggactctatgacgggaatctgggaattatttctgctctggaagctgtcaggatgatgaatgattatcaagtggagacggctcatccgattgaggtggttgcatttaacgctgaagaaggcagtgaaatgggaggaacatttggcagccgtgtaatgaccggacgtcaggatttgaaagaaaagggattatgcgaaaaactggcccgctatggtctggactgcagtgatttggaaaggtctattcgtgatatgaatcaggtcggggcatttatcgagctgcatattgaacagggagcatatctggtgaatgaaggctgcgacatcggaattgtagacgggattgttggaattacccgctatatggttcatataaccggagaatccaaccatgcgggtacaacgccgatgaagctgagaaaagatccggtgagggctgcatccttactcatagaaaagatatgggatactgcgctcagatacggacatccttttgtcgccactgtgggggatgtcagggtaaaacccgggatgtataatgtaattccttctgaggtagtccttttactggaactgcgtgacctggatccggtcagggtagagcattttacagaggaactgaagctatatggcagcgttgaggaagaattgaaaccgtttggaattgaatttgaacttcaggttgacaaaccgtcgagaatgctggacggcgctgttatcaatgcaatttccgaggtatgccaaaaagagcctcaaattcgctccgtaacgatgtcaagcggtgcgggccatgattcaaaagagataatataccgggtaccggccgggatgatttttgttccgagtgaagacggtatcagccattcgcccagggaatatacgacggaggctcagatagaaaagggaaccagggtgttgtatcagacactgattcttatggacaaaatgaagtgggggagagaaaatgaagatattggtaataaatcccaacagcagtatcgaaatgacggagtcaattaaagagacggtccgtgccgcagcaggagacagatttgaagcagaggtatgccgcatcacggaggcgcctccctttatcggcagttatgcggatcagctggcctcagggccgcacctcttgagactattgaaggaacaggaggacaattatgatggatttatcattgcatgccatctggatccctgcctggatgctgcaaaagagataacagagaaaccggtgatggggattggtgaggtctctatgaggatggcgccgcttcttggccggaagttttccgtagttggctcaagttccgccactacttatctgaaacgccgtatggtggaacagtacggactggaaaaatttctcgcatctgtcagggcaccaaaacctgagtggacaggaagccaggaagaactgttgattcgcgcggccgggcaggcggtccgggaggacggagccgatgttatcgtactggggtgcgccggttttacaggattagatgaagcgattaaagacgacgtaaaagtaccggttctggatggtgtggcatgcgcgctggccgttatggagggggtgctgaacatgagagggtgcacctgccgtaaataatagcaaatgatattcaaaaagacatcgtgatatagtataatcccgacagaaattgcacaaaagccggacggccggaaagagccgtccggcttttgtgctgcctgttatttgctgcatggattaacagggcatgtgaatcatccagtcagagatgttctgttaagtttgacaaccgttatagttgcagtaccttcagtgttggtgacaggactgttaaaagtcagggaaaaacgggtctgctccggaacgtcgatgataatggagttggagccatatgcggttgtataatttgaagcggttctaaagtatattccatattcaatatgcgaacttccattgtaatatggtgtgatttgcatatatcccggtgtactgagaatggaagaaacatggtatgaaattaaataatatccgggagcaaggtcaatatgggtgggatccgataagacgatctgcccggtgggatcagccgtagacgttcccagtggtatttgtgtggcgttggtaaatggaattgcaaaagtggcaaatgaggcaaaaacatcgtctggggcttcgccggcaggtccggtagcgccggtcgggccagtagcaccggttgctcccgttggaccggtagcgccagtaggaccggcggggccggtagtgccagtaggaccggcggggccggtagtgccagtaggaccggtggggccggtagtgcctataaggccagtagcacctgtaggtccggtagcgccggtaggcccagtaggcccggcggggccggtagcgcctataaagccagcagcgcctgtaggtccggtagcgccagtgggtccggaaggtccagtaggcccggcgggtccggtagcgcctataaggccagcagcccctgtaggtccggtaggcccggcaggtccggtagcaccagtagaaccagtagcgccagtaggcccagtaggcccggcaggcccgtttgcgccggtagttccagtaggcccggcaggccctgtgggtccggaaggtccagtaggcccggcgggtccggtagcgcctataaggccagcagcaccagtaggtccggttggcccggcaggtccggtgggtccggaaggtccagtaggcccggcgggtccggtagcgcctataaggccagcagcccctgtaggtccggtaggcccggcaggtccggcaggtccggtagcaccagtagaaccagtagcgccagtaggcccagtaggcccggcaggcccgtttgcgccggtagttccggtaggcccggcaggccctgtgggtccggaaggtccagtaggcccggcgggtccggtagcgcctataaggccagcagcaccagtaggtccggttggcccggcaggtccggtagcaccagtagagccagtagagccagtaggcccagtagcaccggcaggcccggtatttccgcgcggaatttcaaaattaagaaccggcctgcagcaagttcctgagttagtgaccctggcgctgcttcccggtactccggtcagtgtagcgcccactgtcacagaagggcagcaggcgtgagggcatggtctgtgacactgcccctgataaggagagcaggagcagacttgttttgcataatctttaaagttatcatcaatatacataaaagacacctggtatatttaaaggtcttattgtagaatatgaaaatatggacaaaaggtgcggcctgtctgccggagcgttactgttcacaatccgccaaaaaacggcgcgtcgtgaaattcgggattttcgtgcaaaatgtgcacgaaaacacctggcggaaacacctgtgtgaacagtaacgccgctacctcaaaaaacatcatataaaaaaataatagcagttgaaacttttctgaaattcagaccgtctaaaggttaagaaaggagagtagaaaagtgggaaaagagacaatgcgggataaactggaagaagtaattctggcttcctatgaatccatgtacaggatggcatttgtatatatgaaaaatgaatcggatgcattagatgtggtacaggaaagtgtggtcaaggccatcaagagttccggccagctgaaagaggaatcttatatgaaaacatggctgtttcggatcgtaatcaatactgcccttgatgaactggaaaaaagaaagaagatacttcccctgtactcggaaaacgaagattcaaaagaagacagatattgtgattttgatacgataaattctctggcacagctggagcaaacggaaaagacgattattctgctccgatattgtgaggagtggaaactggaagagatagcggagtatatgggacttaacctgaatacggttaagagcattctgtacagaagcttgaaaaaattgaaaacagaattgatgaaaggagaggcggtttcatgaaaaaagcggacaaaggccgggaagaaataactgatactgagagaaaagaactggaactcctgacggaggataaggaatttaatcagagattgagcaaactggaaaaggaatatcaggagataaagataccggatgaattgaaaggaagagtgatacaggcaatgcaggaagcgcgtaacgacgcaaaagcggagccggatgcctcagacaaaaagatggaggaggatccgagaatgaatcgaataagaagaaaacaaaaggataaaaaaacggcagtccattatctgctcaggacaacacagaccgcagcggcagctctgctcgtcatcacggtcctggctaatacaaatgcccagacagcttacgctatggggaaaatcccggtaatcggggccattacaaaagtagtcacattccggacatatgaaaagcagaatgagaattcggaagcaaaagtggaggttccccagattgaggctgcgaaagattccggtatttcaaatgcggccgatcaggtaaacaaatcggtagaagagtatacaaaccaggttatcgcccagttcgaggaagacgtgaagagggacggagaggaagcgcatctgggagtgtacacggaatataaggtgctggccgacaataaccggttctttacactgaagattgagacggatgaaattatggcaagcggatatcagaccgtcaaaatttacaatatagataagaagagcgataagatattacaattaaaggatatgttcccggaaggcacggattatgtaactcttttgagtaatgcggcaaaagaagtgatgcaaaaaaacatgcaggaagatgaagataaagtatatttcctgaatgatgagatgggagctgattttgacaaaatcaaagaggatcagaatttctatatagacgatgcgggacggatggttctggtttttgatgagtatgaagttgctcccggatttatgggaatcgtagagatcacgataccggaaacaatttaccatgcggacggactgtaagaataaataaaaattccgcagagcgctttttaccgtcgaggagcctgaagtttttgttgtatacaggcaggcaatatgatatcatgatctcagaaaatgtctacagagaagaggagtttctaatgaaccgtccgatttaactgcaattttaacatttcatcagcagcagacgtatttcgatgatggagataagagtgatgacctgtgcgcgtagcgtgcaggttattgctgttgtgtttaaaattacaggggacagtttattatgcgaataaaaaagaatctggtgatcatgtatgcacttgcctgtctgcatggcatggtgttctatggcccggttgcagtactgtaccgtcaggcggcaggtgtatccgtctttcagacagctttgattgaaagtatttctcttgtgctgaccgtgctgcttgagcttccctggggaattgctgcagacagaatcgggtaccggcgcacattgattatctgcagcgtcctgttttttatatctaaaattattttctggagggccgacagctttggctggttcctggcagaacggctgctgcttggcatagtctgtgcaggtatgtcgggcgtggatgccgccgtactttatttatcctgtgaagacggcggggcgcagaaggtttttagcatatataataactggggcatggcaggacttctggcagcatctgcggtttattcagccgtgataggcgaaaactaccgccttgccggtctgatgaccgtgttcagctatggactgggggcagtactggtctttggacttcaggatgtgaaggggcaggagagcagaacacatactgtgcttacggaggggccgtatttatggaaaaggctgttctttaataaaaatatattttttctgcttttagcatctgcattgttaagtgagacacatcagacgatcaccgtatttttgaaccagctgcaatttgtccgttccggtatgaatgccggtatgattgcagcggtatatatggtgatgacgttatccggcctgctcggaggtgcttcggcccgggtaacagagcggttcggcgtgcaaaaaacgggaacggcattatttttgatttgcagcatcgcgtgctttattctggctttaacatgccggatgggaccgtcaattgcagctgttttgacactgcacatcagccatagtgtttttcaaccgctccagatggaactgcaaaaccgtgtaatcaataccggtaaccgcgcgaccgctcttagtttcaatgcggttatcatgaataccacggctgtattaataaatcttattatgggcaaagcggcggaatcggatctgagaatttcaatggcattgggcggcgttttctgcacggtaggatttgtattgtttcagttatatgaaaaaaaccggaaatagaagaaatagaaaaaatggaagcatatagaagaagaggacagcacggttcagtaatgtcgagggccggccggtgatagccggccggccctggttgactggattgatggcgttgacctgtgcgcggagcgttcaggttacctcttacagactgtccgccatctcatacaggagacgctcggaatcatcccatcccagacacggatccgtaatcgatttcccgtagcagtgctcatcaactttctgacatcctggctcaatgtaactttcgatcataacacctttaacaaaattgcggatgtcatcggagtggcggcggctgtgaagcacttcttttacaattcggatctgttccatgtattgtttattggaattagaatggttggcatccacgatacatgcaggatactgcagatcacgttccatataaagttcgtggagcagctttaaatcttcaaagtggtagttaggctggcactggccatgtttgttgacggaacctctcaaaatagagtgggtcagcggattgcctttggtcttaacttcccagcttctgtagatgaattcatggccgtgctggcctgcgtggacggcattgagcatgacggagagaccgccgctggtcggatttttcatgccgacaggcacatcaatgccgctggaaacgagacggtgctgctggttttcaacagaacgggcgccaactgctatgtaggacataacatcgttgaggtaagtcaggttttccggatacagcatttcatcggctgtggagaagcctgtttcctcaattacgcgcatatgcagcttcctgattgcgatcaggccttcgtaaagatcgggctttttctccgggttcggctggtgcagaagccctttatagccgtcgccggtggttcgcggtttgttggtgtaaatacggggaaccagaatcagtttatccttcaccctgtcctgaactttggccaggcggttaacgtaatcgcatacggaatctgccctgtcggcggaacaaggtccgatgataacgaggaatttatcgctttttcccgtaaatacatcccggatttccgcatcttttaccgccttgactgcggccagttccggcgccagcggaaactgttcctttatctcgtccggtgtcggcagtttgctgacatattcaaatcccatggctttctcctcctgcaaatcgtaagctattcgtaacgaaaattctattgtaatttatatgtgcgtccattataatatagaaattccgattcggcaagaggccgcaggctttttgctgtttctgtgcatcgcaatacaaataacaataaaataattgacaagggagacttaccatgaaaaaaagaacactgatttttgcagcggcggcactggcagcgggcctcacggcctgcgcaccaaaggcaggggagacacagccgccagctacgatagaggagacacaggaaatgacacaggaaccggccacggaagacagtgatgagccggagacacaggagccgggcggtacggaaaacggtgagacatcagatggcggagcaggcgagacggctcagatctcggatgaactgctgggaaaggtttatacggctgtaaaagaggcatacggtgagaaatatgtgccaggcatgatgtttgacgaagccatgctggaaggaacattcggcatttccaaagaccagtatgattcctatgtggccgaaggcccgatgatttcggttcatgtggagacatttgtcggaatcaaggcaaaggaaggaaaggccggggatgtggcaaaggagctggaggcatacagaaagaaacagattgaagaagctgtccagtatccgatgaatatgactaaactggaagcatcccaggtaataacgcatggagattatgtattctttgtcatgctggggggagccgatatggaggcggaagagcagggtgcagatgcggcgcttaaatctgcgaaggaaaataatcagattgcggttgatgtaatcgccggttttttcaaatagcgtaataatataaaataaaatgtaaggagagccggatatggtattttcaagtctgttattcctgttccggttccttccggcagcgcttttagcatattttgcggcaccgcgcagataccggaacggaatactgtttgtttcaagcctgatattttatggttggggggagcctgtgtatattctgctcctccttttttccaccatcgttgattttattcacggaaagctggtggaccattataaacgtgagggcaatttgggaggggcgaagctagctgtagcttcctccgtcctgatcaatctgggtcttcttggaatcttcaaatatacggatttcctgatcggcgcattcaacactgttacggggaagggagtgcctcttctgaatcttgctctccctatcggaatttccttttacacattccagacgatgtcttacactattgatgtatacaggggtaaggccggagtccagaccagcattatcgcattcggcgcctatgtttcgatgttcccgcagctgattgccggtccgattgtccgctacagtacgattgccggggaactgacaagccggaaagagaccttggccggtttttcagaaggggccgtcctgtttgcagcaggtctggggaagaaagttttattcgccaatcagctggggcagatatggaacgagattatccatattgttccggaacagagaagcgttttgatggtttggatcggaattttcgcctttggaatgcagatatatttcgatttttccggatattccgatatggctctgggactgggacggatgttcgggtttcatttcccggagaatttccactacccctatgaatcgaagagtattactgagttctggcggcggtggcacatttccctgggaacctggtttaaagagtacgtctattttcctctgggaggcagccggtgcaaaaaagccggacagcttcgcaatatcctgattgtctggctgcttacaggaatctggcatggcgcgggatggaatttcctgctatggggattatactttgccgccttccttctgttagaaaagtttttcttaaaagagagactggaaaagtgcccggccttcatccgctggctctacgcaatgctggctgtctttatgggatgggtgctgtttgctttcgatgatatgcaggccgggcttctgtatttcagacagcttttcggcgcggccgggcttagcctggtaaatgaaagaacgctgtatattctgtttacgaacctgattttgatggccgcagcggcaattggggccacttccctgccaatcgctttctgcagggagcatatacagaaaaaatcactgccgatattggaaccgatctttgttgccgcagtgcttctggtgtctacggcttttctggtaaatgcaggatacaatccgttcctgtatttcagattttagggagggggtaagcattatgcgcagagaaataatgacggcatcggcttttataatccctctggctttactgtccgtcttaagcgccgtcatgccccagaaggcattctcggaggaggagaaccggtatctggcgcagaaaccggttttcacgatagaatcgtttaaagacggtaaatttggtaacgactatgagacatggctctcggatcagttcccattcagaaaaacctttgtggctgccaagacgaacgcggacagactgattctgagggaggatgtgaatgatgtctattttggtaaggatcattattatatagaaaaaacagacccggaaaatctgctgacacctcagctttatgagaatctggattatctgtcggacgcagccgcacagtttaattctatggttggggcagagcatgttaagatcatgctggttccttctgcatctcagattctgaaagataaactcccgccttttgcggctcctgccgatcagagtgaagcagcacggattgcacgtgataaaatcagggagaaaacaggggaagaaggcaattttctcgatattgaaggcacgcttttaaaggcatgggaggaatgccgtaaaatagcgtcggaatatcaggctggcgaagaacagctttattataaaaccgatcaccactggacaacgctgggggcctggtatgcgtaccggctgtatgggcgggaggcgggatttgaaccgtggggaagagacaggtttacagagattgtagtatcagacaattttcagggaacaattcagtcaaaactgggagtggctctggttccggataccattactctttttattccgggcagccccacatcggtaaacgtatattatgacggattgccgaaggcctatgacactttgtataataagaaagcgcttgaaaaaaaagatcagtattccgttttccttgacggaaatcacggtttaacgaaaatcgtaaataatatggcaggggtggaggcaaagggtaaaagacttctgataattaaggactcctatgcacattcctttgcgccctttgtcatcaatcattttgaggaggtatatatgattgatctcagatattttaatatgaagccggccgagtttgcaaagagccgggaaatcacggatattctggttctttatcagataccaggatttgcaaaagacgggaatctcttcaagatggtccgctaaaacttgacggattggcgtttttctactaaaatagactatatcaaaaaaaataaaaatttttttggtatacgtgcaataaaatgcgcatgtggtgcattaacttattgaacggatgaaaatcatttctgtttgggagactgaaagcggatgggtaacaacacaaatatcaagttactcgaaattccttgatgcattacactccgttacgattctgccgacggcagtaccttacagaaaatcatttcaacagcaggttgacgacaaccagagcctgccgttgagtaaaaaagaaccggactgaatttttcagtgccggtcttttttatttcacaggagtactttcctatgaaataaaaaagaccggcactgcggcggagttaatcctataaaattaaggataaaatatattgactttttggccaaaacaggatataaatgtcaggcatggtttaacctgccgtgcattattaagcgggaatacgtaagaatgatataaaaggcggcttgaaatgaaaatagaaaatgatcttggcaaggacgacataaagcgacttgtcatcagaatagccatcccttccatgctggcccagtttgtaaacgtgctgtacagtgtggtggatcggatgtacataggaaatattgcagagattggagagaaggctcttgccggagtcggcgtctgcggacccatcgtgacgatgatatcggcgtttgcctcacttgtgggaatcggcggttcgccgctcatgagcatcaagatgggagagggcagcgagaaagaagcgaaaaagatactggccaacagctttctgatgcttgccgtgatttcggtcatcacaacggccggggcgctgctattgaaaaataatctgctgatgtggtttggcgccagcgagacaatctttccgtatgcgaaccaatatataacaatttatctgctcggcaccatttttgccctgatggcggtggggatgaaccagtttattatctgtcagggatttgcgaaggtgggaatgaaatccgttacactgggagccattattaatattattctggatcccgtatttattttcgtattggagatgggggtccggggagctgcgctggcaacggtcctgtcccagatggcgtcctgtgcctttgtactcctgttcctgttcagcaaaaaggttccgattcgaatcagctttggcggttatgagtggagaattatcagaaagataacggtgctgggaatgacgccgtttctgattattgcctttgataatgtgctgattatcactttgaacgccgctctccagcattatggcggagcggagggagacaagcttctgacctgcgccaccatagtgcagagcttcatgctgatggtgaccatgccgctgggcggtatcacgggaggtacggagccgatactcggatataatttcggggccaggcgtaccgaccgggtaatcagagcccagaaatatattgcctgttttgccttggtatttacttcggtcatgtttatagcttcacagaccctgccccattattttgtcaggattttcactcataatgaagaatatatttcattgactgtctgggcaatccggatttatacggtaggtatcatcccgcttgcactccagtatgtggtggttgacggatttaccggaatgggagttgcctcggtcgccatcttcctgtccatgttcaggaaggttctgtatttgggaggcgtctttgtacttcctgtcctgtttggcgtaacctcaatcttttataccgaggctatctcggattttggcggtacggtgatgagtattgccgtgtatattgtattaatccggaagatattgaacaggcgtgaaaaaggagaactttaagaaaagataataatttattcggcaaaaggcggcagagggaaatgcaaaatacattttcatctgccgcccgtttatcattgatttatattcagcgcatatcttctacaagaagtatcctgattgtgtctggtgacgggttccagttcataacatataaggtgtaaatacggttaggattgaggttaataaaggtagagagcaggttgactgccggtctggcggatcttgccacgtttacggagtaagttcctgactggagcctgctgaagcttccggcgtttccgggctgggtgtttgtgaagctcatgaaagcattcggcagcgttacattgacggcgccgcttgcataggccaggttgcagacccgcagacaggaagtattgaaggatgtgttgcagcctccgtccgggaaggcgttgatggccatacggttgttgatgcttacaatggcaatcgtagagttatacccaaagaacatattctgctgaaggtagacaaggccgttcggagccatgattgtaattctgtgaaatcctctggaatactgtctgtagcggctgacctcggcaaaatccatgttggtgagaatcgtcctgttatcgacctgtatggtaagatttgaatgcacgggcgaagcatttaaaaaccggatgctgaagccgcgtgtcggctgcggcataggaagacagttaccacaagggataacaggtcccgggccgcctggaaaccatacgggaggaacggagaagtccgggtcgatcacgccgttgtcgggcataacggagaaatccggatcgattacgtcgttgtcggggaaaacagagaagtccgggtcgatcatgttgttgtcgggcataacggagaagcctggatcgaccatgttgttatcgggcatgacggaaaaatcggagtcaacgcctctgttgttttgtgcgccgttaaaattgtcattcacattgagggtgtgaacatccggcatctggttcatttcatgtagcatatcatacctcgtttattaagtgtttatagtaaaagtctattcaacggcgctgcaaaatgagcatggacgtcaaatatagttgtgtttcggcctttaaatgctccgacaaattgccacaaaattcgagtctgtttacctgaaaattacataaattttacatattttacaaaaagcttgaaatagctattttccctgtgctatgataaaaacgatcggcttttaatccggcaatttttctgctgtaaaaaagccggcacaggaggatatttatatgtcaataaatgatgtaagcaatctgtttacatttgccggagggctgggcatgttcctgtatggaatgcgcatcatgggcgacggcatgcagaagacagccggcagcaagatgaaccactttcttgggatggtgacaaacaacaggcttctgggcgtagccctgggagctttaattacggcaattcttcacagcagcgcggcgacgacggttatggttgtcggttttgtcaatgctgggattctgaatctgacacaggcggtgggcgttatcatgggcgctaatatcggtacgacgatcacggcctggatggtttctttaaatcagctcggagacgcgtttaccgtactccagcctgcattttttgcacctctgtgtatcggcatcggtacattcctgattgtattttcaaagagacaaaaaaataatctgatcggagaaattgtcataggcgtcggacttcttttcgtgggcctggaatttatgagcaatgcgatcaacccctatacggatgctcctatatttgcaaaggcatttgccgtcatggggcgcaatccgattctgggcattatcaccggcgcccttgttacggctcttcttcaaagctctacggcatccgtaggtatcctgcagacgctggcgatgaacggtgttgttacaacgggggcggccatctacataaccctcggacagaacatcggaacctgccttaccgccatgctttccagtgccggggccaaccggacggcaaagagggcggcggcaatccatctgacctttaatacgctgggtgccgttatatttggtgtggcgatgtacgcgctgtcactgctccggcctgccatggccggttcggagataaattccgttcagatttccatgttccatacgatattcaatgtgacgaacactcttcttttatatccgtttgccggacagctggtgaaaatttccggcctgctcgtgaaggacggagaggccgaaaaagaggcgggagaagaacggggagagatcgagaccgcattccgccacctggatcagcgtatttttgaatcgcctgtttttgccatcgaggtggctcagatggagactgtgcatatgggacagatagccctcaataatatccgtctggcaacgaatgccattttgagcagagataaggagaaggcgaaagaagtatacggaaatgaaaaagatatagataaaatggaggagctgctgaccggttacctcattaaagtcaataatctgtcactgacggagcaccagaagctccaggtcaataatctgttttacagcatcagtgatattgagagggttggcgatcactgtgagaacctggcagagcaggccgactatatggcggagcataatgtatcattttctgatacgggaaatgaagatttgagcgccatcagtgagaaagtggtcaaatccttcacccacgccatagccgccaggcagaccggcgatatggacgatgttaggaaggtcagccagtatgaggacgatgtggacatgctggaggaagaactgagggataagcatattgagcgcctttcgagcggtcagtgcgatccgtcctccggcgtcgtgttcctggatataataagcaatctggaaaggatttcagatcatgcctataatctggcaggatatgtgaaagatgagatatagacaggagaaagtttataaagacgaaatgagaacacccgatggaagatgatattacctccatcgggtgttctcattataggaaacattactgcccatccagataacctttctcaagataataccgttcggcccccttatggagcggaacagccagttcattgcagataaaccccttttgcgtcaggctgctcagagattcgtggctggcggccagctgagggatggattcatccaatatctttgtaatacggtaaacgagttcctcgtccatattctcatctacgcagagaagacatttgataccgaaggagtcgatatcctcactctggcccggatacgttcctgctggtatggttgttttataatagaaagaattctttgaaagaatcttcttaagctctgcaggcgtatatttcaggagccggcaggggacagactcggcaagttctgtaagtccgctgatgggaactccggcaaacccgtgtactgcgtcgagttttccttcccggacagcgacggaaccggagccgagcccggaattgaccagagtggtggatgatccgagtccgaccacatcaatggcaatacgggcggacagatcggtggttgaaccctggggtccgatggctgcgcttttaccgttcagatcgtggacataagtgagccctgccgattcgggcgccatccaattggaaacactggtataaatggctccgatagccctcaggcttttaattggtttatcggcaaaatcatcggttccgtaataagccgaccaggccacatctccgctgaccaggcccatgtcaatctgtccccccgtaatccattcgacgttggtaaaggagccgtttgaagcgctgagattgaccttaatattagagtcgtgttcactgattactttggcaagcgcattgccgaccggatacatggttcccccgctgtcggcggttccgattgtaagaaccgtcagcccggtgctcacctccggtaaattttccactttttccgtcaatgccgggttgtcggacgtattggaggaacagctgcatgcagtgcaggcaaaacccgtcagtgcagctaataagaaagcttttaaatatacctttttcattatacagatcacctgttttattaaagtgttaaacacagcagtcacatgtaaacattataatctaaaatggcgccggatcaataccttaaccattgaagagaaaatatacaaaatctttacacttatattctactataacacaggtgtaaagattcgtccaagacaaattgttttgcgaagactgggatgttgctttggcgaggaatgaacagcagcattggaagctgcgcttgggcagggaaacagaatcgggattgatatgaaaaaacgtccggcagattgggggcgccggacgtttaagtgaatttattatttgtaaatgaacgtgaaccttatttgataaagcttccgaatacggaaaggaagatagggttgtaaatatcatcaatgattacggcgaaggatgggtaaagaacccatgcaacattgtgccatccgtattcatccataacagctttctcatttgctacggcgttcggaccggagccgcatccccatccgcagtttccggcagccataacagcagcgccatagttgcggccaaacatgttgtaggagacgaagattgcaaatgcagccatcaggagggcctggcagagaaggatgatacccatctgacctgctacaggagccagctttgtaatatcggttgtcataagaaccagagcgaggtagagttccaggaacatatgctcgattgcgtcaacctcaggaacataaaacttgatgttgcaggcctccattacattacgcgcgattgcgcctgcaaacagacagccaatgaatttcggcatttcaatcattgggatattgtcaaggatacagtaaatcggcataccgagagcggcaatcagcagagtcatggcaaacatggaaatcattctgccgttgtcaagcgttgcagccgtaccggtttttgctgattcgggtttatcgttcgggtcggatttcaggttgttgcgcgtaatcaggaaggcagccacaggtccgccgattaaggaacccatgatgttgcccattgtacctgccgccacaccgatagtagtggcatccggcgcgccccaggactcaaagatcgggccaaatgcggaagccgtacctacaccgcctgacattgctgaagaggaacactgcagcgccagaagcggatgaagtccaatcaggttgccgacaaacacgcccagaagatcctggagagtgattaaaagacaggcagcgattgcaatcatggcacagagcttgccgcctgcatgacgaagcatctttaagctgaaaccgaaacctacgcagaggaagaacaggttctgacataaatctttcattatcgtggcatcgaaggaaagtccgatgatgccggaacccttaataatagcgacaacaattgaaaagatgataccggatacaaccggtgcggggattgcgtatttacgcagtaattttgagtggtttacaatcgcacgccccaagaagataacgatggcggcaaaaccgagagtggtaagatactcaaatttgaaattagcaacagccccatctgccgccggtgtgtaagtaccgaaatagcccataatagtttccattgatacataccctccatttcttttttataaaatttatttattttttataaacaaagtgtaaaatatgtaggaggtgaagtcaatttttgtaattaagaaaagcctttagtaactatagtaaatgggttttggatgtatattctgacgaaatgggggaagagagaaatattgactgataaagaatatggaattgctgcagcctgaaaatacccaaaagtgcagcagcgccggaccgttacggcagaaggcggccgcggctgcacacggggtttatggttgattgcggtgttctgtgcgcggaatgtgcaggctgtcatttgttaatatagcggtatcggatggaaggccgtcctcctgtctggtaatcaatggtactgattagctctccggtctccagcatataattcatataccttcggattgtgatacgcgacaggtgaatctgctctgctatctgttcactggaatactggacatccctgttatccttcaggaaaccgcgtatcagtcccagtgtggtttcgttcagccccttggtcaggccggcggcctgggagccggtattctcctgacgggccagcagtttatcaatctctccctgccccatgttgttttttgcctggtttaaatactccttcatctggctgtatttttcaagagcggcctggaaacgcgggtattcaaacggttttacaagatagtcaatcacaccgcgggacaaaagctgtacgacgatatccgtgtcgctggcagaggtcaccatgatgatggacggggctttaccggttgcatgaagccggtcgatgaattcggcgccgttcatcagcggggtatagtaatcaagaataatcaaatcgacatcttcatcattcagatactcaagcgcttcaattccgcttttaaagacctttatcacccggaaggacggggtcagttccacatactgcttattgatggaggctaccatcggatcatcttctattataataacctggtacattaaaggttctcctttcttgtgaaagtgagcgtaaagcaggtgccctcgcccatctccgtatctatggaaatttctccctgataatcttctgtaatctgtttaatcagataaaggccggttcccctgttttccccctttgaggagattcctttatcaaatatatgattcagcagttcctggggaattccattcccggtatcctcgcaggtaatgatattgcagtcggggcggcagtaaattccgagagtgatttcttttaactcctgatttgaatttacagagctgttcagctcctcgatggcattttccagcaaattccctataatcgtaataacggaatcctgcaaaagcagcagttcactttcgatgcagctgctgtcatgggtcagagtaaggcggattccgagttccgcagcatgcatcattttaccgatgacaagcgcacagattctggatacacggatggaatcggctgtttcccggatagactggctggacaccagattactgttgatgataaattgttttgcctgatcgatttcacccgtctgcagataacctaggattacatgaagcttgtttagaaattcatggttaaaggcgcgaagcgtatcaagcatgctgcgggtgccggtcagctcgtccgacagagagagaaactccgtcctgtccacagcgatggccagcatgccctgtatgggttttttgccctttccctgaatcggtatttcattcatcagaatggtccgcccgcctatggagcatgtctggcgccggactgatttaccggtgttgatgacagtgtcgaatttggtgtcaggatacagctcacggatatgcctgcccatcaggggagggccctcgtcgggaccgtccgaaaacaggtttcttgcaacgatattagagaaaaggatttttccgtctgtatcggtggctatcagtccttcttctatagaattcatcacatcatcctggcgtatatacatattgagaagctcatgagggttgaagcccatcaaagattttctcagaaagcggataaatgcatgggtaaggaatgtactcacgagcatcatcagaataaagatagccaggtgaactatcagtatgttacggtgccttgccgatatatgggcggtgaagacagaggccatgacaaaaccgatgattgtcccgtcactgcttttgaccgcgtggaatgcacgcctctgtgcgcctttggttccgtagccggttgtgatataaggctcgctcccctgaagaatccgggtctcgtccccgtcaacgaaggtttcgcctgttttcagccggtccgtgtggtaaaagcgcaggctgttgctgtcacagataacaacgacgctgatatcggggagattattgcagagtgaatcaatgtcctgttttgcgagagcgctgggataacctgcctccagcatggagacaacctggggcatcgaggcaatataggaggcggtgccgcttatggtggcgtccatatccgccctctgccgcgtgatatcaaagtacagggtaatacccagtgaaaggacgataattaaagcggaaagcagtgtaaaagagcggtacagcttcttttcaagctcgttccgggatgctgtctgatccaagatgcacctcctttagcagtttgacggtgaaaagtccgcaaaaagatgtgcggacacttaatcatgcttcattatattaaaaaaagaaggttttcgcaacagcaatcaaaagtccatggatgaaaacagagagagcgggaataatatttatgaaatttcaaaaaaacccttgctattttggaattaattggttacaatacaaggtaggttgattattatttaacaatcatgaatagaatatattcttaggaggaatgaaatcatggcagtaaaagttgcaatcaatggttttggccgtatcggccgtctggcattcagacagatgtttggcgctgagggttacgaggtagtggcaatcaacgacttaacaaacccaacaatgttagctcatcttttaaagtatgattccgcacagggcagatatgaaggacatactgtagaagcaggcgaagattacattgttgtagacggcaagaagatcacaatctacgctaaagctaacgctgctgaacttccttggggagagatcggtgtagacgtagtattagagtgtaccggtttttatacatcaaaagctaaagcacaggctcatatcgacgcaggcgctaagaaagtagttatctccgcaccggctggaaatgatcttccaacagttgttttcaatgtaaaccatgacatactgacaaaagaagatacaatcatatccgcagcatcctgtacaacaaactgtctggctccgatggctaaggcactgaacgactacgctccgattcagtccggtatcatgtcaacaatccatgcatacacaggcgatcagatgatccttgacggacctcacagaaaaggcgacttaagaagagcaagagcaggcgctgtcaatatcgttccgaactccacaggcgctgcaaaagcaattggtcttgttattccggaattaaacggcaaattaatcggttccgcacagcgtgtaccggttccgacaggctccaccacaattctcgtggcagttgttaaaaaagccggtgttacaaaagaagaaatcaatgccgctatgaaagctgctgaaacagagtccttcggttacacagaagatgaaatcgtatcctccgatatcgtaggcgtcagatacggctccttattcgatgcaacacagaccatggtttcccagattggcgatgatttatatcaggtacaggttgtttcctggtatgacaatgaaaactcctatacaagccagatggttcgtacgatcaaatacttcgcagaattatcataatagacagacggcacgaaaatcccgagtttcacggcgcgaagcgatgttttcacagcattgccgctttttggcaaaggtgtgaaaagtaactataaggattcaacatgggtccggtccacaggaccggacctgtttttgtttttagtaaccggtaaactctttcagttaagaaaggagtatcttccatgctgaataaaaaatcagttgacgatatcaatgtaaaaggaaaaaaagttctggtgcgctgtgatttcaacgtgccgttaaaagagggaaaaatcaccgatgagaaccgtctggtggcagcgcttcccactatcaaaaaattaataggcgacggcggcagagtaattctctgttcccatctcggtaagccaaagggcgagccaaagccggagctgtcgttagcgcccgtagccgtgcgtctttccgagctgcttggccaggaagtgaaatttgcggctgatcccgaagtcgttggaccaaatgcaaaggcggccgtagacggcatgaaagacggagatgttgtattacttgagaatacacgttacagagcggaagagacaaagaacggagaggcattcagtaaagatcttgcttccctctgtgaaatttatgtggatgatgcatttggaacggcgcaccgcgcacactgctccaatgttggcgtaacccggtacgtttctgaggcggcagtcggatacttaatgcagaaggagattgatttcctcggaaatgcggtgaacaatcccgttcgtccttttgtagcaatccttggcggagcgaaggttgccgataaattaaatgttatttcaaatcttctggagaaatgcgacactctgataatcggaggaggcatggcatttacgttcttgaaggctcaggggaaagaaattggaaaatctcttgtggatgacacaaaactggagtactgccgtgagatggtggagaaggcggagaagctcggcaagaagctgcttcttccggtcgatgccgccgtggccgtatcgttcccgaatccaattgatgctccgattgatatacagtatgtatccgttgatgctattccggcagacacgatgggactcgatatcgggacagaaactgcaaagctctatgccgatgccgtgaaatcagctaaaaccgttgtatggaacggaccgatgggagtatttgagaatccggtactggcgaaaggaaccatcgccgtggcagaagcgctggctgagacagaggctaccacgattatcggcggcggagattccgcggcagccgtaaaccagcttggattcggtgataagatgagccacatttccacaggcggcggagcctccctggaattccttgaaggcaaagaactcccgggtgtggcggcggcaaatgaccgataatgacaggcaagtgaggccgtgcttattttcaacagtttttaaaatcaggaggataaaataatggcaagaagaaagattgtggcgggcaactggaaaatgaacatgactccgagtgaggcggttgcccttgttaatacattaaaaccgctggttgcttcggatgagacggacgttgtcttctgcgtaccggctatcgatattatccctgtagtggaggcatgtaagggaacgaatattgcagtaggtgcagagaatatgtactacgaagaaaaaggcgcctataccggagagattgctccgaatatgcttacggatgccggtgttaaatacgtaattatcggacattccgagagaagagaatatttcgcagaatcagacgagactgtgaataaaaaagttctcaaggcatttgagcacggcctgacgcctatcatctgctgcggcgagactttaacacagagagagcagggaattacgattgactggatccgccagcagatcaaaattgctttcttaaatgtgacggcagaacaggctaaggcggccgtaattgcatatgagccaatctgggcaatcggaacaggaaagacggctacaacagagcaggctgaagaagtatgcgccgcaatccgcgcatgcatcagggaaatctatgatgaagcgacggcagaggccattcgtattcagtacggcggttccgttaacggcggtaatgctgccgaactgtttgcccaggcagacatcgacggaggcctggtcggcggagcttccctgaaagaagaattcggaaagatcgttaattacaaataataagattttgatatttaggagccaaccggccatatgacaggccggctggcttttttttgatggcggtgacctgtgcgcggagcgtagtacccttcctggagcagcggcattgaaaccccgtatttgctgtgctataataaataatcagggaacaatgaaattacttgacttagattacatctgaaaggggacagaacacatggacagaccggttaggaggctgcgtatggagcatggccttaatataagggatatgggtggattcgagacaaacgacggcagggtaacggcttttgggaagcttctgagagcgggagcgcttcaaaagctgacaccgcaggagtggggacggctgaaggagtatggagtgaggacggttctggatctccgcagcctggctgagatagaaacgggcagggatgcagtacccgagggcgtggagtggtaccactgtccgttacagagagagcagatagatgcaaaggacataaccggatcggcggaacgggcgtttgccggcagtctgacagatggatatttaaatattgttaaaaccaacggagcgcttttagcctcggcggtcaggcagctaattgcaggtcttgaaaaaggggcggtcctttttcactgtacggccggaaaagacagaaccggaattttggcatcctgtattttcactctctgcgggatttcccaggaagatattgtcgcagattatgaggtgacatatacatataacaaaaaagggatgaacaggctgctccggatgcttgatgaagagaccagaggcaggatggaaccgcttatgagatcggatgcggagagcatggaacgccttcttgctttttatcaggagatacgtctctcaaaatatctggaggcgtatggtttgacagaagaagagatggaaactctgaaacattattttctggtataatcaaccggtacggtggatgcaggcggtttccgaatcagggaggatacgcgtgaaaaataacaggctttttaaaacgaatgctgtaatcagcttaattttgctcattggtttcgccctgacggcagcgctttcttaccacgctaattacaggacgtctcttgacagtatggaacagatatctacactgacggcagacggtatctgctatcagctgacagctatgtttacgaagccggtcaatgtttctctgaccatgtcccatgacagtctgctgcgggaacatctttcaaaggagacggagtatcttgaggatgaaaaatacgttgacacaacgagaaattatcttgatacataccgggaaaagtacggattcgattccgtcttcctggtatccgccgccacgtcccgctattataactttaatggaattgaccgcgtattgacggaagacagcccggagaatgcatggtactatgatttactgaaaagcgatgccgaatattcgatgaatgtggacaatgacgaggtggaaggcgccgacaatgtgcttaccgtctttgtgaactgcaaagtgaaggcgggggacggctccatcctcgggattgtcggtgtcggaatccggatagattacctggaagagctgctccggacgtatgaagataaattcaatgtcacagcaggactgctgggggaagacggaaccatagagatctccactgcccacaatgggcatgtgaagacagactggtttgaacttaacggccgccataatatcagggggcagatacttgactggagggaaaagaatacaaacctggaaatttgggcggacaaagaagaaagcggaaaggaaaggagctacatcgtggcccggtatattccggaactgaactggcacctggtggtggaacagaatacgggccagctgctgcatggaatccggatccagataatcctgacgggaatcctgctgattattatcgtcgtgtcggttcttctcatcattaccgcagtaatcaggaatttcaacaagcagattacagagctgatggaggaacggcaggaaagctttgtcagagccaccgaacagctctatgataatatctatgagatcaatatcactaaaaattgcagtgtcgggaaaagaacgcgggagtattttaaaagtctgggcgccaacgatctgccgtacagcgagggtctgcgtgtcattgccgataagcagataaaagaagagttcagggagggctatgtctcgacctttgatccgcccaatgttatccgggaatatgaacgcgggaatcatcatctgcgctatgatttccagatgtcggaggacgcagataagtatttctggatgagaatagatgcctacgttttctattcggcggaagatgactctattcacatgtttacctatagaaagaatattgaggaggagaagaaaattcaaatccaggccgtgctggatgagatgacccggttctacagtaaaagggaaacggaacgcctgatcgaaacagtactttccgggacaccgggcggaaggtatgccttttttatcttcgacattgacaatttcaagcaggcgaatgattgctatggccatcggtttggagatttttgcatcaaagaattcagcagtatcatcagaaaacatttcagggaaaaagatattctgggaagaatcggaggcgatgaatttgcagcctttataccggttcccgatattggatgggcgcggaagaaagccggtgagctggcagaagcgctgaatacggttattgagaatcaggacaggagctggcagatgtcggtgagtatcggagtggccgtttacccggaggcaggaacactgtttgaagaactttacgggaatgccgataaagcgctatatgaaactaaaatcagaggcaggaacggatttaccatattccagccttatgacgagaaagggcaggagacggagctggaaaatgaataaacagcacgccgtttttggcgggatgtgaacagtaaccgtctggaaaatttcgtcaaaaatttgtcatacagccattgaaacttgcaatgaaatcatgtaaaataagaaattggcaagaataatataaatgcctcctgttttacctgaatcactgcagtttcgatggttttattaaagacggcgatccgtgggcggagcgtgcaggttatcgttcaggtataaaaggagaagaagataaaggagatagattatgagcaaaaaaccaactgtattaatgatacttgatggttatggactgaacagcaactgtgagcataatgcggtttgcgaagcaaaaacgccggtgatggatcagttaatgagccagtgtccttacgtgagaggcaatgccagcggccttgccgtgggtcttccggacggtcagatgggtaattccgaggtgggacatctgaacatgggtgcaggccgtatcgtatatcaggaactgaccagaattacaaaatctatcgaagacggagatttctttactgtcccggaatttctggaggcagttgagaactgtaaaaaaaacaattcggcgctgcatcttttcggccttgtctccgacggaggtgtccacagtcataatacccatatttacggactccttgagctggcaaagcgtaacggcctgacggatgtatatgtacactgtttcctggacggacgcgatacaccgcctgcatcgggaaaggattttgtcgccgggctggaggcaaagatgaaggaaatcggcgttggacgcgttgcctccgtaatgggccgttactatgcgatggaccgggataagaactgggacagggtaaaacgtgcttacgacgttctgaccaggggagagggcgaaaaggcggataccgccacaggcgggatccaggcgtcctatgaccgggaaattaatgatgagtttgtcgtaccttttaatgtggaggaaaacggccgtccggtagctgtgattcaggacaaagattccgtgattttctttaatttccgtcccgaccgcgccagagaaattacaagagcattctgtgacactgattttaacggttttgaaagagacaaaaaactcgatttggtatttgtatgctttaccgattatgatgagaccatcggcaataagctggtcgctttcaggaaagaggagattacaaacactttcggagaattcctggccgcccatggaaagacacaggcaagaatagccgaaacggagaaatatgcccatgtaacctttttctttaacggcggaattgaagagccgaacgcaggcgaagaccggattctcgtcccatctccaaaggaggttccgacttacgatttaaaaccagaaatgagcgcaccccaggtttgtgataaactggtggaggcaattaaatcggataagtacgatgtgatagtcatcaacttcgcaaatcctgatatggtaggccataccggcgttgaggatgccgcgatcaaggcgattgagacagtggatgcctgcgtgggaagaacggtcgaggcgataaaggaaaccgggggtgtcctgtttatctgtgccgatcacggcaatgccgagcagttggttgattatgagacgggcgagccctggaccgcccatacaacgaaccaggtaccgttcatccttgtcaatgcagatccttcttataaattgagagaaggcggatgcctggccgatattgcgccgactttgatcgaactgatgggaatggaacagccgaaagagatgacggggaaatcccttctggtaaaataatgttatgatgttggggtcaaaaggtcttttgacccctttatgctgtaacgcccggctgtaaatgtctgtcatacatttacagccgggcgttatccgacagccgggttaattcagtgaatccttttcataaagccggtggtatatctcttcgctgacggagtcaacgtatgcctgattgggaagatcctgctgcgtgacaagaaaatcctgtatcagctcaaaacgcttcagttccaattcctcgcctgccaggcccggatcttctttcttaagctcttcatcgagggaaccgccggtccatgtggagataaaccattcgattaaatcctttgtacatctttcttcctcttccgcctgtttttgcactgcagcgatggagctgcgcgtccgaaacgagacaaaaagacaggcgagtcctaaaagtgtgatgacagactggaagaaaattctggaaccgcctgtcatcggaagactgataatcccggcccagcagacagcggcaaacacggttgcggcgcctcccaccatcaggaaagcggaactggaggaatggagatcctcgcatctttgacggctgcttatatagacgcctgaagaggctgctctcgtcccggactgaccggacggtttcgtatcagccggaataccgttctgctgcggttcactgtcatggcttaaaagggcttcaaaattctccaggttttccagattggccaggttgtcaaaatcaaccagattatccagaatttcggaggcgtcaattccatccgtctgctgatagcggccggaagcggcatctatctgctgctgtttctttttctcacgcatttctgcctcataagcttcctgtgattcaacaagatcgcctccgcagtcgctgcacgttgtgattccatcgacaaattccatgtcgcatttcgggcaataaggcataataggttctccttggtatttaatatagatttattataagatagaaaagatgaaacgtctacactaacgtcataaataaagtacttccatttatatagaaaataagatagaataaaaagggcgttccaaagaaggggagaagaacttatgaaccggatgaagacgagtgaattgatgaagcgtttcgcaccttactatttcaaatactggaaggcactgctgtttgatttgttctgcgcggcacttacgacactgtgcgaaattgtgcttccgctgattctgagatatattacaaatgaaggcatgtataatctggcaaatctgactgtaaaaacgattgtcaccatcggccttctgtatttcgggctccggataatagacggtctggccaacttttatatggcttatacaggtcatattatgggggccagaatcgagacggatatgagaaccgacgcattctgccatttgcagaagctgtcggacagtttttacagcaatacaaaggtggggcagattatggcccgcattacaagcgacttgtttgacgtgacggaatttgcccatcactgcccggaagaattttttatagcattcctgaaaatcgtcatctcattttttatcctggccaggattaatctgcttctcacggtggttatatttatttttatccctgttatggctgtctcctgcacttattttaacctgaaggtgcgttctgcctttaagatgcagcgcaatcatgtgggagagctgaatgcaagaatcgaggacagtctgctgggcaaccgggtagtcagggcttttggcaatgagaaactggagattgagaagtttcagcaggataatctcaaatttttagatatcaaaaaacacacgtatttttatatggcggcattccaggatacggtgagaatgtttgacggaattatgtacgtggtggtaatcattgcaggagggacatttttagtaaaaggaatcataaatcccggtgatttggttgcttatacgatgtatgtgacgacacttttatcgacgatccggagaattatcgaatttgccgagcagttccagagaggtatgacgggaatcgagaggttctgtgaaattatggacgccgatattgatatttttgacgatgccgatgcggaggagttaaaggattccagaggcgaaatcacgtttgagaatgtaacatttgaatatccggatgaccataatcaggtcctttccgatatcaacctgacgatccgtccgggcgagagaattgccctggtagggccttcgggcggaggaaagacgacgctctgcaacctgattccaagattttatgatccgacggaggggagaatcttagttgacgggaaggacttgaggaagcttacgctggagagcctcaggagccaggtgggaatggtacagcaggacgtgtatttgttttccggcactatttatgataatattgtatacggaaagccgggcgcctgcagagaggaagttatggaagcggcgaagatggccggggccgatgaatttattaaagagatggcaatgggatatgatacctatgtcggtgagcggggggtaaagctctccggagggcagaagcagcgcatcagcattgccagggtatttctgaaaaatccgccgattctgattctcgatgaggcgacttcggctcttgacaatgaaagcgagaagatggtctccaggtctcttgacaagctggcggtgggcagaacgactctcacaatcgcccacaggctgagtacgatccggggagccgaccggattttagtgctgtccggtaatcggatcgaggaagaaggcagccatggcgagctgatggccaaagagggaatttactatcatttatatatgtctgccaatggattttcagaggaagcggcagagtgattggaggaaatttgaatgaaaattgcagttgtgacagacagcaacagcggtattacacaagcgcaggggaaggaacttggaattacggttcttccaatgccatttatgattgacggaaatgaattttttgaagatatcagcctgacacagcaggaattttatgggaagatggaagaggacatggatatttccacatcacagccgtcacctgagtcgattgtggagctgtgggaggcgctgcttgaagaatatgacgggattgtccatataccgatgtccagcggcctgtctggttcctgtcagacggcgctgatgctggcagaggagtttgacggccgtgtccaggtggtaaacaaccaccggatttcagtaacccagaggcagtcggccctggatgcccttgagatggcggggaaaggaatggatgccgttcaaattaaggaagtgctggagagaaccggttctgagtccacgatttacatcacggtggacactttaaaatacctgaaaaaaggtggaagaatcacgcctgcggccgcggcgctgggaacgcttctgcgtctgaaaccggtcctgaccatacagggagagaagctggatgctttcgccaaggcaaggacgatgaagcaggcaaaatccatgatgatatccgcaatccagcatgatttggagacgaggtgggatgataaagaagggaaaaagacccatctggagattgcccatacgaactgtgaggaagcggctctgcagcttaaggaggagcttctggagcttttccctgatacggatatccatattgatcctctgtctttgagcgttgcctgccatatcgggcccggcgcactggcaatagcggcggtgaaaaaattagaaatttaatttggaaagcatgaaaaaattgattaaaaaaattaggtttagacgttgtgtaagtatgaaagttcctctgctgttctgtttcctgctggtaacgctggtgcctcttcttgtgcaggccaggtttctggcaggttttttccggcagagccagattgaggacagcatgatagaggcgcagagcaaatgcctgatgcttaccaacaagatgataaccctggattacatcaataacatgtcgaataacccggggctggacgcggagatgaacgtgacggccgatctgtttaacggccgcattgtcgtgattgacagcagcttcaaaatcatcaaggacacgttcgagctgaccaagggaaaaacgagtgtggttgaggaagtgctccgctcctttgaaggggagacgatcaaccgccggaataaagaaaaagattacttttatctgacgcttcccgtatattccaaggcggattcgcagaaggtggagggggttctgctgatgacggcttccaccgagagcatggcccttctggagaatcaggtgatgcataaagccggctttcttcagttcgtgctttttctgttcgtggctgtgatagatttattggctgcgtcatttcttatgaagccgtttaagaagcttcaggagcgtctgaatatggtgtctgaggggaatttagatcaggatatccaggtagacgactacaaagagacaaggggaatatccaatgccgtcagccagactctccgcaagttaaaggctgtggatcagtcgagacaggaatttgtatcaaatgtatcgcacgaattgaaaacaccgatcacatcgatccgagtcctcgcggattccctgatggggatggaggatgctccggtggagctgtacagggaatttatggtggatatttcagatgagatagacagggaaggaaagattattgatgatcttttatccctggtgaagatggataagtcatcaccggatttgaatatcacatcggtttcaattaatgcattaatggagcagattctgaagcggctccggccgattgccaagaagcgcaatatagagctggtatttgagagccagagagaagtcacggcggatgtggacgaggtaaagctctccctggctttgagcaacctggtggagaatgcggttaaatacaaccatgaagacggatgggttcatgtggttttggacgcggatcacaaattcttctatgtaaaggtaatcgataacggagtcgggattgctcccgaattccaggagcatgtgtttgagcgtttctacagggtggataaagcgcgttcaagggagaccggcggaacagggcttggactggcgattacgagaaacatcgtgatattacaccagggagccattaagctccagagtaaggaaggcgagggaactactttcacggtacgtatcccgctaaactatattccctgatatctgatgtgaaaggacggagtatatttgaaacgattattatatctgacggcagtttttttgatgtgtgcaggcatttgcggatgcggacagaaagagaagaaccagacgccggaggatggcacctaccggatttattatctcaattcaacaagaacaaagcttgccagcgtggagtataaaacagagacaaccgatcaggaaacattaatcggggagctggcgggccagattctggcggctcccgacaatcccgattaccaggcggctctgggagagaaggtcatacttctggatatcaggaaagaggagaacgttctttacctgaattttaataaagactatacggcgatgaagccgaccagggagattctgtgccgtgcggctctggctaagacgttcacccaggtggcaggcattgattatatcagtattaactgtgacggccagccccttctggatcagcagggaaatccggtgggcgctttttcagcctctgattttgtcgaaagtatttcggatgtcaattcatttgagcgggtggagctgaagctttattttgccaatgaaaaaaaggatcttctggttcccgagaccagggaggtaatccacaatgtcaatacctctcttgagaggctggtggtggaacagctgattgcaggctcccagacaggcgcttcgccggtgcttcctaaggatacgagaatattgaatgtgtcattgacggacaacatctgttacgtgaacctggacagcacgtttttaaacggcgaagtggaggcagaagactatatcccggtctatgcgctcgtcaactcgctgacggagcttcagacagtgaataaggtgcagattacggtgaatggttcggctaacgtggcgtaccgcaatgtgatttcccttgccgcgccgctggaacgggaagagaaatatgtggaaagcaaataaaaccccggaggaggaataacaattaaaagaccgcttttatggataacaggagcttatgtacttggagaggtcactgcttactggtccggtaaaatggcggaatatggaggaagggctgtggcgtccggcagtctctttccgatggcgttaatactggcagcaggcattcttttccagcttcatgagaaaatcaggaaaagaggtctgcttttatttatcctgcttgtctgctgcctgggcggctggttcaggatgacggaggagatgaaagaaggaccgctggaggccatgctggcgtccggagctatagagacggagaaccgaagccgggcggaggccgaagggcggatttcccaggctctgctgaaggacggaaattacaccattattctggaaccggcgacggttcgtgcaggcggaaagcaatatgaagaaaaaaggctgatgatttcagcaaaagaaagcaggaacggtgcggtgccggaggaggggatgtatctgtacgcaaaggggaaggcggaactctttcaggaggcaagaaatccgggggaatttgattaccgcctgtattaccgctcacaaaagctgagatgccgtctcagagctgataaaatggaaattatctcaggagagcgtcctgcttttcaatcccagctcattatgttccgcagatttgtcaaggaggcccttgcatttctttatcaggaggaggacagggggatttttcaggcagtgcttctcggggataagagcagcatggacagcgatatacgggagttgtaccaggatggaggaatcgcccatgttctggctgtaagcggcctccatgtctcactgataggaatgagtctgtatgggtttctgcggaaaagaggcgtcggatatggttgggcggggacggccgcggcaatcctgctgttcttctacggagcgctggccggctttggggcatctgtattccgggccgtgtttatggtgttctgttcgtttcttgcgtcttatctggggagaacctatgatctgctgtcggccatggctttgtccctgattttactcgcatccgattcgccttatcttttgtttacaagcgggctgcagctgtcctacggggcagtgggggcggtgggactcgccggcagcatgaaaatccacggcagccctctgttcacggccatgtcggccagtatagcaattcagattgtgactctgcctgttatcctgtaccatttctttgagtttcccctttacggcctgcttctgaatcttgtggtcattcccctcatggcttatgctgccggttccggaattatatcggtcggcctgtatggtatctggaaagcggccgaagtgccaggcgttctgttatttgcagagggaagcaaagtcgtaggaatgggcagcaggcttgggacggttatggacaagaccgcgggaatactggaagggatctgccatggggcggcgggaccggggcactacatactgaccttttaccgggagctttgccgtttttcactgaaacttccattctccacggtagcggcgggacggccctctcttgcctgcatcgcattttattacggcgttctcgcagttttatactttcatttaaccagcaaaaacagcggcgctctgagcagaaaagaaggaaatgaatttaacgggaagcaggcctgtctctttgcctgtgcgctgcttttgctgatggtaaaaccgcgcgtcagcggaatggaggtctggtttcttgatgtcggccagggggacggaattttctttcgtacagggacggcagctgtgctgacagactgcggcagcagccagtataaaagtgtggggaaaaacagactggtcccgtttttaaagagtaaaggaatcagacggctggattatatttttatcagtcatgcggacagcgaccatataaacggaattgtctggatgctggaaaatgaaacggatttagaggttggaacgattattatgcccggaccgggacggggggaagaggaataccgggagatagaagagcttggcagaaggcgcaaaaccatagcttgttatatgaatgccggggaaaagctggaacggggggagcttaaaattacggctgtttatccggatgcgtcagcatcgccaaaggatcggaacggccattccctggtactttcggtgcgataccgtgattttacaatgctcttaacaggcgatgtgggacagacgggagaagaaatcatgcttgatgaaaaatacagccccggtagagagctgccgggcggaaacctgtccgttttaaaagcggctcatcatggttccgccacctcgacaggagaagaattcctgaaacagttaaatccggcagtgacagtactttcctatggtaaaggaaattcttacggacacccggccaaggaggtgttgaaacgtcttacggatgccggaactatgatatggagtacggagaattccggcgccatccatctcacaacggacggaaggaaaatgaaggcagaaggttttctgctggacaggaacaagggttccgggctataatactcaacaggaacgttatagttcagcgttcaatgttgtttagttaagcaggtgaggacgccgccggtacggccggcggacggggtggcggggggtggatatgagtctttcgtcccgggggaggattgttgtggtctggggctgcgggcgaagataaagtctgcggagcacgctcccgctctgtgaaatgcatcgcgctgctaagctcggcaggacctcgctaatcagcgatggatttaggcggcatccgcagactttatcttcccctccgccccaaggccaggttttcgccgggacgaaagactcaaggccaagggtatcgcccgtccgccggcctgcggccgctgaatgtctcacgcgttaagtgcggggggcggaccttgtcgcggccaatcagcgctaccatgtacgaaacatacgatatgccttcgatgcgcctttatgaaagaattgcggaagatttgatattagcttgccggaaacacgtagtggccgcgacagggccctccccatttaaggttggagacaatcagcgcccggaacggaccgggtccggtgccccaaaaaccttcgccggagtcttccgtccccgtcgaaaacctgaccgggggaagtaggcggaatcaattgcggaggggacatgggagtccgccggtgcttagcgaggttccttacgagcttagcattccgatgcgcactccaaagagtgcaaacggtccccgcagcaattcattccggccggattccccctcacgacaacctccaaccggggacggaagacttagccagccccctcaccacactggacatggtccattccggacgcgtcctccgggcctcagttaaatctccaatttattgcactgttaactaaatgacattggttcagcctttggccaaacggcaatatatgatgcacagaaacggcaaagaacgccgttaattgtacaggaacattctcctggcggtactcaggacagatgaaggagcagagtgcagatgcagacaattaatgaagacattaaaagcggacaatataaaaaagtttacctgttatatggggaagaatccttcctcaagcagagctataaaaagaaattaaaagaagcggtcgccggcgacgacacgatgaattataattacttcgagggaaaaggactggatgtgaatgagctgatcagtctttccgacaccatgccattttttagtgataaaaggctgattataatcgaggacagcggatttttcaaaacttcctccgaggctctcgccgattacctgccgatgataccggatactacctgtattgtcttcgtggaagatgcggtggataagagaaacaggctgtttaaaaaggttaaagagctggggcatgcggctgagatgaaacgccaggacagcgcccagcttgctaggtgggcaggcacgatcctggcgcagaacggcagaaagataaccggctctacgatgaacctttttctggagcgtaccggggacgatatggagaacatcaggatggagctggaaaagctgatttcctatacaatgggaagcgacgtagttacaactgaggatgtggaggcagtcacaacggtacaggtaaccaataagatatttgacatggtcaatgccattgtgacaagaaagacgagactggccatggacttatatgaggatcttctgacgctcaaagaaccgccgatgcggatactcttcctgatagctaggcagtttaaccagcttctgttggtcaaagaaatgacggcaaagggaacagacaggggaacgatcgcatcaaagctgaaaattccgccctttgtggccggaaaagtatcggcccaggccggcgcgttcaccagagaacagattttgtcctacgtaaaaggctgtgttgaggctgaggaagcagtgaagacgggaaagatgaatgacaggatggcggtggaattattgattacgagaaaatattgatttagttaaacaggtgaggatgccgccggtacggccagcggacgggggggtgtatatgagtctttcgtcccgggggaagattgtcgtggtatggggctgcgggcgaagataaagtctgcggagcacgctcccgctctgtgaaatgcatcgcgctgctaggctcgaaaagacctcgccaatcagcgatggatttaggcggcatccgcagaccgcctttatgaaagaattgcactggagttgatatctgcctgcggaaacacgtagtggccgcgacagggccctccccatttaaggttggagacaatcagcgcccgaaacggaccatgaccggtgtgcgaaaacctacgcctgagtcttccgtccccggcgaaaatctgacccggggaaggaggcggaatcaattctgcaggggatatggaagcccatccgtgcttaatgaggtttctcacgaatttagcacggctatgcgcttcgaaaagtgcaaacggtccccgtaagaattcattccggccggattcccacctcacgacaaccttcaaccagggacggaagactccgccagccccctcaccataccggacatggtccgttcaggacgcgtcctccgggcctcagttaaatctccatacagaaaaaaggttcccgccacaccaagcggaaaccttttttctattataatgggttaattgattgtataaattgaaagttccaaaaattaagccattgcgttaacggctttagataaacgggatactttgcgggaagctgtgtttttgtggtaaactcccttggaagtagccttgtcaatctcgctgatagcaactaataatgcagcctgtgcagcagccttgtcaccggcagtaatagcagcttcaactttcttggtaactgttttaaccttggatctgattgctttgtttcttgcagctcttgtttcagctactaaaattctcttctttgcagatttaatgttagccaatctgtacacctccatctgatatatcatatattatcaattctttggtttgcattaaagcctggacacggacagttcaatgtaaacatactattgtattttatcgaataaagtcagggatgtcaatatgtattttccggaattatacagtttttccggtatattttagaacaaaaacagaaaaactaggaagagatggcatgaaaggagattttcgatgtttaaccggaagaataacagtaataccgatcaaaataaaataggagagcttccgtcatttgaagccaggaccgacctggcggtggaagaacaggaaagctttgccggggacggcggggagataaagggagtggcgcttcgggagtggcaccacagaaacagtcatatcagattgacggaagtttcgattatggatgagcagggagcgcgggccatgggaaaaccggtgggaacatatctgacccttgacgtgccggatatggcggaaaaggatgacggataccatgaagaggtagccgaggagcttggaaaacaattgaatcttctgattaaaaaaatgtgtccgaataagaaagaaaaagcctcagttcttgtcgtgggactcggtaatatccaggtgacgccggattccctcggtccccgggtcgtggataacctgcagatgaccaggcattttctcggtgagtatggcgaggatttctgtgaaagaaatgatttgcctgtattgagcggaattattcccggagttatggcacagacgggaatggagacggccgaaattgtaaaaggagtagtagacgagacgaagccggacatggtattggctattgatgccctggcggcaaggaatgtgaggcgtctcgcatccacaatccagctcacggatacggggattcatccgggctcaggcgtcggaaaccacaggcacagcatgacgaaagacagccttggcgtgcccgttgcagccctgggaataccgactgtagtgggggcagcagcgatcgttcatggaactgttgaggcattgatccatacattggctatgaacagcggtacggaaggctatgcaaaatatatggaagatttggatccggaaagccagtatgaactgatacgtgagctgatggagccggaattcggaccgatgtttgtgactccccaggatattgacgagagggtgaaacagcttagttttaccgtatcggagggaatacaccgggcgttgtacggaaagaagagttaaaagggctgttccgtacagattaccgttcacaccatgcaaaaagcggcatgccgtaaacaataacatgcttcgcgatgcaccccgtacaggtccgagggaggaagaaattggaaagaatctggtaaaaagaaccggcttctgcatagaatggtagaaggagagaatttttaaggcgggacagacatgaggccgggaaaaataagaattatcagagagtatattgcagggaacagaaaaatatccatattccggccggcagcagcaatcctgtgcctgttcttgtttgctttttttgcaggcagggcggttgggagactgccgtcagccgcgtggaatatcattacgggctcaatggggggctttgagagcaggacggccctttttatatggaagaactggtatccgtcggccggattttctgaagccggatatggaaatatgaaagatgaggcagaggatatggccggccggctggccggttttattctgaaacaggtaccttactacaggatggcggaaggcggacaggaaaagctccgcagggagctggagccggatccctcttatgcagattatctggagagcagccggattttaaaagagtatgagtgccttgtgagagatttggagggcagcagcgtactgacttcgggaggggttactacatacagggatacggaagagctggcggataattccggagcgtacggagagaatgaacttacagatggcgcggtacaggggcagaaccagggaaaaggacaggaagacttaatacagaccgccggaggacaaaatcaggccggcagccggatatcaggcggtcgtccggccggtgacgcgctgttaaataaagggactgtcagcgcttcggggatcaaatatgtttcggagcagcttgccgactatgatttcctgatgaagcatttttatacggttcatcccacaacgacggccggcagggacatgatgagcgccggtacttttttatctgagaattttgctctcacacaggggaacgataaaccccagattttgatttaccatacacactcccaggaggaatttaccgattttcatgagggcaataaagaagcaacaattgtcggggtaggaaattacctcacggagcttttgcagcagaaaggctataatgtgatacatgacacgtcggtgtatgacctcagggatggaaagctggatcggagcaaggcttatacatatgcattagaaggagtcacggcaattttacagaaatatccgtcaattcaggtggttctcgatattcacagggacggcgtgaaggagacgacgcatcttgtaaaagagataaatggaaaaccgactgctaccatcatgttttttaacggaaccagccagactccggaaggcccgattgaatatttgaaaaatccttacagaacggataatatggctttcagcttccagatgaagctctgtgccgatgcctgttaccccggatttacgagaaaaatttatctgaaaggtctccgatataaccagcatgtcaggccctgctcggcgttaatcgaggttggcgctcagaacaatacatatgaagaggccaggaatgcgatggaacctctggcggagctgctggatatggtggtaaggccggaaggctagcagcttcacacatctttaataaaatcatatgtggagttgcggtagtagtatttaacaaataaaaatccaagcagggttaccagcgtcgttaaaataccgccttctattccgaagataccgcctgtgataaagttatcggctgtaaagtgtgttgtaatcattccggtaacgttaattccgctgacaggcataccaaagacaaggccctggaaagagttccaggtgaagtgatatccgatgcacatccatatattacctgagcgtatatacatataagaaaacagcagccctgccagaatgatgttacaaacggaaaaaaaagtcaccccgttatttcccagatgtataagtccaaaaataaaagaggggaccagcacaataaaaggaaggtttcccaccctgcgcagggtggacatcagaaatcccctgtttatgatttcttctcccagggctacgaatataaggacaatgagccaccataactgaaggattgaaaaagatggtacccatgattcgacaactgcctggccggagacgactgtaatgaaaaatacggtgaaacagcagagagcgccgagaaacatgccggcatacaactccttatacctcattttaacgggcttcagccccatggaggaaagagagcgtttcatcaccaaacaccatgcgccgattggcgtcagtatcataactaagtcatataatatctgcatgtagaatggtaagaatatattatacacccaatcaaagacggcatccggctgctctcctgcagagggataatgaccgctggcgctcagtaagttttgtaataacccaatagacagaaacgacagtaaatcggtgatggcatacaatgccgcccatacaagcaggataatccaaccggaacgaatctgaccgcgtttgtttttaattactggattgtttagaagaaagttcataattttccacctttttgatttattataatgagtcattctaatgctatcataacgattattgagtgaaagtacaataatttagttaaatttatttgatgatacggaaactgtgcagatgcgtgaaacgggtgtggtccatatggtaaattatcattgtgaatcaaaaaagagtcgcttaactggttattaagcgactcttttttttgctaaaagggggattatcttcatttcacagtagagaccctattcagattgcgctttgaaaacgcctgttttgaataaaaaccggcatataaggaagaaaaataagaaaatattttacatttattcccttaacattcattttttatcagttgaccatcctcagaaagggtgatataatttacaggaatcgagcggaaatgatgaaaatcccccttttagcaaaaaaaagagtcgcttaataaccagttaagcgaaccttttgaaagaaaaggagggcttttgtgagctggtatgtcttacaatgcagaaccggtcgggaaggcgaaattatacgctcctgcaggcagcatatttcagcggatgctcttaaggaagtgttctcatttcgttgcgagaggctgtggcgtacagacggagtctggaaacttgttgaaaaagaaatgtttccgggatacgtttttctggagagcagccggcccgacaagctgtcggaggagctggaggcctacagaaagattctgagagtcatggaagaaccgggatatttaatttctgtgtacgaggaggaagaggaatatctcagaaagctttgcggagagcggcattatctcaaaatgtccttcggttataaggataaagaaaagggaaggtcttttataacagagggcccgcttaagggactggagaatcagattgccaaatatgattggcaccgtcgttttgcccaactcagaatacctgtttccagaaaagaggtagtagtctgggcggggatcggattcgatgagaggatcctggtagatcgggatgacgggaggccgggaatagcgcaggaggaaatgcagtttctggtttcataaatttgtaaaatatacaggagggctgtacagctattgaggcatgcagccggacggtattgttataatagtgaatataatcctgggatttttcaaataaaattccagggatggcgaagctatgtctttttaaggcagaaagggagcaggaatatgtggtatgtaattcagactgtgaccgggaaagaagaggaactgatgctctttataaggaacatactttgccgggagcgctatgaatcgtgctttgtaatatatgcacaatggatgaaacggctgggaggcgagtggcagatacaggtgcggccgctatttcccggctatgtttttatagacacggaggagccggaacggctctatatggatctgaaggcggtgccgaaattctcaagactgctggggactggaacggatgaattcgttccggtgaagaaggaagaggagaaattccttagaatgataaccggcggcagcggggaaatggcagatgaacctgcgatagaacggatggaaagagctgatgatgcgaccgtgaagctgacggttgtggagacgaaactggacggcgggattcgttcaatggaaggagcgctttcctgctttgccagcgatgatgtcaggttaaatcttcataagcggtatgcggtggtaaagacacggatgctgggggaggagagaacgctggtgtttggtataagactaaaaaaggacaggtaaatacggggaggcatgtgatagaagaatgtatcagaaatatataaaaagatggttagatatttgtttatccggtctggggctgatgattttatcgcccttttttttattgattattatagcgataaaaaaagattcttccggaccggttctgttcaaacaaaaaagagtggggattcataaaactcattttaatattttgaagttccggacaatgcgtaccgatacgccgaaagatatgccgacgcacatgctggcggatccggagcaatacataacgaaggtgggaaaatttctgcggaagacgtcactggacgaactgccgcagattattaatatcttgaaaggtgatatgagtattatcggtcccaggccggctctttggaatcagtatgatctgatcgcggagagggataaatatggggccaatggtgtgatgccggggttgaccggatgggcgcagatcaacggaagggacgagctggagatcccagtgaaagccaggatggacggggagtatgtgaagcggctgagcttccagtttgactgtatctgttttttgggcacgattctgtcggtgttcaggcacgacggagtagttgaaggcggaactggggagatgaaaaaaagaggagaaagagatagagtatgaatcaaataccacacattatgacaaatgacaaactcgtcctcatcggggtcaccggtttaaagtcaggaggagtactgatagatcatatagcgtcaaatctggataaagtgaaaactttatttccgggtggaattgtggttatctgtcgtgaaacatcaaagacagaaaaagtagagaaattgcttccggatgtgaccataaaacggggagagattactgatgaaagttttctatctgattcgctcagtggctgtgatacgctaattcatgttgcgggtatccactggtcgagagaaatagttaacgctgctgcgtataacaatataagacggctcatccttgtacacacaacaggtatctatagtaagtacaaagcggcaggggaagaatacagacacattgatgattatgtagaaaaacaatgcaaagagaacaacattatcctgacaattttgcgcccgactatgatttacggaaacattcatgatatgaatgtggtgaaatttatttcattagtggataaatttccgattatgccaattgtcagaagtgcgaggtttgaacttcagccggttcattataaggatctcggaaaagcatattatgatgttctaatgaatgagaaaacttgcggccataattacaatctttcaggcggcgagataattcaacttcgggatatgctcaccgtaatcggggagaaccttggaaagaaagtcatattcatcagctgtccattctggatcgcttacggtggtgcctggggattgtattgcgcgtcctttggtcgtattgattatagagagaaagttcaaaggctttgtgagccaagagtatatgatcatgatgatgcaacaagagatttcggatataaccccaggatgtttcggattggtattgttgatgaagttaaggagtatttgcagaataaatgaaaacataatttagtattcccttggagttattcagtgtgcttcatagttacgaatattaggttgacaaaggagaaagaaaaatgcgaatagctttcatatatgagagtggatttgccggaaataatggatcgaatcatttgttatgtaccacgattgaaaaaatgcttcagagaggacattccgttgatttaatagaggcggtttctgttcgagataatccggattatcctccgcaacttgctcaacataatttccaatgccatacgattgagcttaaagaaacgaaaaagacgaactttataggcagatatctgtatggacttagttttgtgcgggaatcaactaaattggcaaaagatttggatgttgatttatttttcgtacagtctgttccaactgtatcatttactattcgaagattaaaaaaatatggcaagccaattatatataacattcacgatgtgtttcccgggtcagcttttgaactgggcgttgttaaaagtaagatacttgactatatacttaaaagaatccagcgcatcggttttaaattagcagacagaatcatagttgtttctgatgacatgcgagatgttcttgtcaaggagaaaactgaccccaataaactttttatcgtaaacacctggtatgactcggatagcatcagatatatagcaccagacgtaaacacttttgttaaagaatataacattgatacttctaaattgattatccaatatgccggaaatgtgggacaggtttttggtctggatgagtttgttgagcttgtgaatgcgctgaaagataataagactgttgaatttcacattgtcggtcagggtgtaaaaattgaggaacttaaaaacagaacgcagggttcaaatataaagtttttcggatggcaaaaacaggagcggatgagtgaaatatacagttattgtgatatggagataattccacttcatcacggtgttattggtaataatgtgccgagcaagatggcattatcactggcagttggaaaaccggttataaacattgttgagaagtctgggtattatatgctttttaaggataaccacatcggatattcatttactcaaaatgaaatcaatgatgcgatagacataataaatgaaatttcaaaagacaaaagctgtcttaaggcttatcgggaagacacaagagagtttgctgatagggtttactcgaaagataaaaataatgacagattattagatatgcttgaggaacttcagaaagggtggaaatataaagcatgagcatctttaaagatagtattttgttaattactgggggaacggggtcttttggaaacgcagtgctggagcgtttcgttaatacagatataaaagaaattcgtattttttcccgtgacgagaaaaaacaggatgaaatgcgacatcattacaatagtgataaacttaaattttatattggagatgtcagagatataaatacaattcgctccgcaattaatggtgtagagtatatattccacgccgcagctctaaaacaggttccttcttgcgagtttttccccttagaggcagttaagacaaatgtaataggaactgataatgtattgacggccgccattgaggccggtgtacataaagttgtttgcttgtctactgacaaggcagcgtatcccattaatgctatgggtacaagtaaggccatgatggaaaaggttattatagcgaaggcaagaaacgcagatccccgaagaactcgaatttgctgtactcgatacggaaatgtaatggcatcgagaggctccgttattcctttgtttattgataaaattaaagaaggccttccgttgacggttacggatggcagcatgacaagatttattatgaatctggatgaggctgtggatctggttctctatgcctttgaacacggctcacaaggtgatttatttgttcaaaaagcggatgcaagcacaatatcagatttaacccaggcaatcaaagaactctttggaatgcctgattatccggttcaaacaattggaatcagacatggcgagaagatgtacgaaaccttattgactaatgaagaatgcgcaagagcagaggattgcggtagattttatagagttgtagccgataatcgcaaccttaattacgagaaatatctttcgcaggggaatattaaacggagtagtttgtctgaattcaattctaataatacaaacctgctggacgttgaaggagtgaaaaagaaacttcttacatgtgaaatggttatcaatgagttgaaggcatggaaagagcgtaagggagaataatatgaaatttttagttcttgggtgtaatggcatggcaggtcatatgataagcctttatctgaaagagcgggggcacgatgttctgggggttgctcttacaaagtctcccttggtaaactctatcgttggtgatgctatggatgcaacatttataagggatctcgttggtgtaaataagtttgattcagttattaactgtattggccttttaaatcaagtttgcgaagagcataaggcaaatgcagtgtacctaaactctttctttccgcatcaacttgccatgtttacagatggaacagatacccaagttattcatatgagtacggattgtgtatttagtgggaaacgagggcattataccgaagatgattttcgtgatgggggtacattctatgaccgtactaaggctcttggggaattggaggatgataagaacatcactcttcgaaattcaattgttggacccgatataaatcaaaatggtattggacttctaaattggttcatgcaacagcatggcgaagtgactggctatacaggagcaatgtggactggtcagacaacacttcagcttgctatgacaatggaagcggcagcaaaggagagggcacacggattatacaacacagtaccagacaccagtatatccaagtgtgatttgttacggttgtttaataagtatattcgtaaggaaaaggtgacagtcgtacctgttagcaagatagcggcagataaatcattgaaacggaccagatgggattttagttatagaataccagactatgagcagatggtggcagaactggctgagtggatgagggcccataaagaactgtatctgcattatgatttgtgaagtttattatggaaacataataatcgaaaatacgtgttcactcaagtgaaacaaaatggaagagaggcgagtgttgctgatgaatggagaatttgtaaactatctaaaaaaagtctttatcaaggctatactgcatttcttttggttatttccgttaaatgaaaaaaaaataactttgctaaatgaattatcatatacatttggcgatagcttaaaatattttgatatctatttacataatttgtcaaacaaagagtataaaattgtatttcccataaaagatggagcaccgccctcagtatattctgatgatgttattgtggttccaggttcttttaagtatttcaaggaaataatcacaagcggcataattataacgaatgctggaggagtatcttacttacctaaaaggaaaaaacaacggatcatcagtacatggcatggaggaggtccatacaaaaaaaccagtacggatgtttatgataattactggtataaaaagcaggcagagatgaatgctaataacactgacttcatattatcttcttgtgaatatttctcggcatttgaagcaaagtctatgggatataagccagaagagattattcgcgcaggattacctagaaacgatattttattcattgaccatgacagtataaaaaagaaggtaaggaaatattatgcgattccagataataccaaatttattctatttgctcctacatttagatcaaaagagaatgagttttccgatctgggtgctataaagaattacatcgaacttgatccgggtatgctcatcagcacacttgaagaaaggtatcattgtaaatgggtgtgtggaattaggcttcatcctaaacttgcaaacatagatatgagtaaattgaatgttataaattgtacgaactaccctgatatgcaagaactgctatgttgcgcagatgcagtaatttcagactattcatcgttgatatgggactattcttttacgtacaggccgatttttctatatgctcctgatattaagcagtatgaagaggagagaggattttacatgccatcatccgattggccatatccgattgcacacaataatgaagaaatgcgaaaaatcatcctggaatatgatgaaaataagtatattcaaagagttaaagagcatcataaagcatctggaagctttgaaaatggtaatgcatgcgaaattttattgaagctcatagaacaacattgataaatatcgaacttaataattagatggtgaatttcaaatctaagattcggagaatatcctcatgattttagacgtattagtatatcttgctgttttcgcagtaagtttaataatggcagcaatttttcagaagattcataacaccgcgaagactagatacttatcagcaggtgttgtgaaattaaatacatttacatattgcattaatgggtgtctgtctgttttcccggtaatagctatgttcggtttacgctatggcattggcacagattattttaactatgagcaaatttataacgcggtacacggaacatcgatatgtgattattggagcctacacaaccagaatttcagctacttttatattgaacctggatattatgccttaaacaaaatatttccgtcttttagatggctgctatggggaacaggaatactattatttaccctgcttcttattgcaattaaagattattcaaagcaaattaattttgcttttgctttgtttatttatttatcaacacaatatatatacgcactgaacggcatgagatttgccattgcgattgttctgattctaatcgggtataagtttttaatccagaacaggacaaaaacgtttgtgttgatggtgcttttggcctcgctatttcatcaaactgctcttttttgtttggctatggtgtttctgaaacggtacaaatataaaggtgttgacggaatccgcaatattgttcttatcgcaatgattctgtcattcccgttattgtgtaaatttttgcttgagatacttagtcatatttctctctttgagcgctatttcgatacatttcagtattcagcaagtatgactatgaccattagctggacgtgggtattgcatgtcataccagtaatacttcctctgataatattgtgtggaaaagaaatattcgatgctgagaatactgatattttatttcgaatctgcgttatggaagtgccttttcgaatgctgggattatttaatacttggtatactagattcgccagatattcccagatagcattagttatatttgttcctttagtattgtcaaagattcaaaacaagcagaagaaagcaattttatatctatattacatcgcttggtttgtattttattttgcttattatgcgattgtcaatgatcaaggagattcactgccttatgtctggatattttcttaatattgatgatataaaatgaaatatttatatgccagactgagttttagataattaaaaatcgttaatttgatgggatttaagttatttcagtattttatttgtttctattttgtaatctataaaaaaaaggagatctgccatgtattacgtcaatgaaaagattaaaaatacctatcgcgttccgcagcccgagggaagaggagcttatatacgcctggatcagaatgagaacccggatggtgttccgcagtggctgtttgaatccgtaatggacagagtgacgcctgaatttctgtctatctatcccgaggaaacagtcccaaccatgaagtatgccagaatgcttggcttagagaaggagaaggttactttcacagatggaagcacggtgggcatgggatatatcattaaagttttcggagaacccgggaaagatattctttgcgtgaccccttctttcgcaatgtatgaggtgtattcgaaaatgattggcatgaacgtcaggcagctcgaatatgaaggtgatttctcctataaagtagagaacactttaagtgccatcaacgagaatactggaattgttgttcttgttaatcctaacatgccaattggtaatgtttacagcagaaatgaaattactaaaataattgaaaaagccagaaattatgatgctatcgttatcattgatgaagcctattactatttctatgataagacatccatcgatcttgtgaaggaatatgataatgtgtttgtcttgcggacattctctaagatgctttccattccttcacttcgcctcggtgtcatcatgtcctcgtcggagaacatcaggtacatcaataactataagccccattacactgtcaactccattgcactactttttgctgaggctattgtggacaatcacgacaggttgattacagagttgaagaaacagtatttggagggcaaggattacatcaacaaggctctggctgagaacggatacgagacacttccttccgaagggtgttatatttgcattaagccaaagtacaaaacttccagagagctgaccgatcttctgaaagaaaaaaacatactaatcctgtgtggcaaggatggtctcacaggatggctgcgcttgacaattgcacacaaaaaatatatggaaacttttatggatatattgcttgagatagacaaggcttgaaagatatgagtatgaaaaattatgtgatcttattggcaggcggtgtcgggaagcgaatgcagactgatattccgaagcagttcattgtggtagagggaagaccgatcattgttcatacagccgaaagattccaatgtaatccgcagattgagagtattgttattgtttgtgtaccggagtggattgacaatcttcgttctcttgttgagaaatactcgctgaccaaggtgcgatggattatagaaggcggcagtaccggacatgattctattcgcaatggtgtgttctttttgaaagacaagatcgactcggatgattatatcattgttcatgatgctgtacgacctatattgccacaaaaagcgattgatgaagtaatccgagtatctcatgaaaaaggtaatgcttcatcatccattgcgtgccatcctccaatcgtttacacagaagattttgagtctggaattgctgatgtggatagagagcacgttatgctgaccgcttccccacaggcattcaggtacggacttgctttggaatgttatgaaaaggccgaagaagagaacatgcacaattttaccttcacaagctcattgctcatacattgcggggagcgggtgtactttgccaagggaacgaccagcaacattaaaataacaaccaaagaggatttggctttgttcgaagccttgatgaaggttcccgaggaattgctgtttagctaaagcttacaatccaacattaagggagtgagtgagatatgaattgttcagaatatttagtggattttcttattaatcatggcgtaacagatgtgtttggttatgccggcggttatattgtgccgtttatggatgcattatacaaacgacaggatgaaataaagacgcatgtctgctataacgaacaaggctgcgctcttgcggcagtcggttttgctaggacaagtgggaatatgggagtttattttacaacttccggtcccggtgctgtaaatgctttgggaggcatggctgatgcgtggtttgatggattaccgctcatgggtatctgcggaaacgtacctacgaatgaaatgaagggcttttctggcatccgtcagaatggttttcaggaaatggatattgtttccatgacaaggaacattacaaaatactctgtgacagcaaacagtacagaaggatttccagatatcaccagcagggcttataacatggccatgcttggaaggaagggaggcgttatcattgattttccgctcgatatacaacaagccgatattattggtgggtaatggcgtcagaagcgcggacgcagtaagcatggttcacgagtttgcaaagaagacgaatatccctgtcctgacaacaatgaatggtgttgatctggcgcaggatgatcttcacattggctatattggaacccacggtaaccgtatagcgaatatgattctaaatgaatgtgacttagttatttcagttggagcccgtctcggtatccgtcaagtgggacggacagcaaaaaagtttgccccaaaggctgacctggtacgttgcgatatagatgaatatgaactgagccggaatattaaggttgatgagaagaagtatcagacggatgcccgggattttatgagaatgcttttggcggaagatgttgccgattattctgcctggaaagcgcaatgtctggaagcgaaaaaaatactggaggactatgataagcaaccgggaaatatggcggtagagaaaattgcgtcattacttccgccggatcctgttgtctccgttgatgtaggaatgaatcagtgttggtgtgcacagtcgttggttctgaaagggtataaaggacggatacatatcagcggaggttatggaaccatggggtgcggtctcccttatgcgattggctcctgcatttcgatgggcagtcaggtatcttattgtgtcaccggagacggaggcttccaaatgaatattcaagagttagagactgtaaaacgggaaaatttacctattaagatatttatcctgaataacagagtgctcgggaaaatcagtgaaacacagcatctggagcacaaagaccgcttcgccaatacaacggctggcagtggatataccgttccggcatttgatagaatagccgaagcatatgggattagggcagtaaaactgagttcatatgatgaacttgataagtacgcatcttgggtcgcggacaatgagccttgtttgttcgatattccgttgcctgagaacagtctgttgactccgaagatcaagtttgaaacacaggtaatcagaccggaactggacaacgctgttgtaagcagcgtgaaaagaattttaggaagatgatttaattttaaataaatagccgcgtggtatatggtaataaaatgttcatcgatatctatgggggagaatatgctagttagtgttattgtaccaatatacaatgtatcgttagagttgcttcatcgatgtattgaaagtgtaagacatcaagctgaaaatgatgttgaaatcatcatcattgatgacggaagtgatcagaataattctgatttatatagaaaaatatgtaatgaatactgcgatacacattattacaggcaaacaaattccggcccttctgtcgcaagaaacgtaggggttgaaaaagcacaaggagagtatattctattcttagattccgatgattatattaccgataagtgctttgaacaggcaacaggtatcataaacacatatcgtccggatattgtgattggttatacttatagagatttatcagatgagggaaaaataaaacatacggcggttgatgaaagtcccgagaaattggtacttgatgatgaaaaggaaatggctgtactcctaaatcacatgcttggatacgaggaagccaagtatgtttataagaatggatatattggtgaaggaccatgttgtcgtttctttcgacgtgaattatttgataatagcttatttgatgtcattccaagatggagcgaagatacattatggaatatagaattattaaggaaatgtcatacagcagttatttgtaaatcacgatggtatatatatgccgttagaaaaggctcgacggtgcagggatacagaaacaattgttacgaagaattcatgtatattacagaaaaagttagttctgtaggacattctatttggaacggaaatatagataaaggcgttgcatgtagcgtatggcgtgctatatttatcctttccaggggatatgtttttaacagtaaaaatacagagtcatttggcaggagatatcaaatcttaaaaagagcaataaagagcactcagtttcaaaacgcaatacgattaatagacttccactttgaaacaagaagaaccagaagaattatgaaggagattcttaagttcactatgaaaactcgtctatatctttttacatatatggggattaaactttatgtaggtaagatgtcgtaaaacctgtatacatatgatatttgatgtttccaggtagtgtaaagtggtttatgaaaaactggagtaaaaaataggttccattagaatcttggaaattgcagatgcgttagtttatggcagtgtccaccgcccttgatgatttcgatggcgattttataatgaagaagggggttgttttatgaaacagtttgctttttatcttccacaatttcatagaattccagaaaatgatgaatggtggggaagtggttttacagagtggagaaatgtcaaaaatgcaacgcctctttttaaaggacatatgcagcctaaagttccactagataataattattataacttacttaacaaaaagaccgtggttgaacagactgctttgttacataaatacggtttaagtggactaatatattatcattactattttaatggaaaaacattattagaaaagccagcggaaaatctactctcctggactgacatttctcaaccttttttcttttgttgggcaaaccatacatggtatagatcttgggaggggtcaaaagaagttttaatagaacaaacatatggtactgagtccgattgggaaaagcattttgaatatttattgcctttttttaaagatagtcgatatgaaaaaaagaataataaacctttatttatgatctttaatagtgaatttcaaaaaaagaaggaaatgtttgattattttgaaaagaaatgtattgaaaatggtttctcgggaatttgtattatcgagacttgtgagaatattgataatatggatgttcagcaaaagagtaaaagcaaccaatgtgagtatttatttttacgtgaaccaactgtcagtagaaatgcatatataaagagtttaagatatgcaccaatacgtttgataagaaaattaaagagactattgtgtggtccttatgttattaaattcaatgggaatcgattatttgatttaatgtgttgttataaattagggaataagagcattgcaagaggtgtgttttttgaatgggataatacgccacgtcattctataagaggaacaattattacgccgccagataaaaaaaggtatttgcaatatatggatagtataaaagacacggaatatttatttataaatgcttggaatgaatgggcggaaggaatgatgctagaaccaacggtagaaaataaatataaatatttggaatggatttcctgttggatagccaatgataaattacgaggaaaaagataaatatgagaactgaaaaaaaagattgtttttattttcctttccatatcggaagcggtaatagaggctgtgaaggaattattgaaggaatttatactattataggcaaagagtgtggagaatatattcttctggatgaaaatgtagatgaaaaaaagttagatgaaacctttggaatctctttttttgcttccctaaatgtaatgtataatttcgaaaattatgggtggctacaaaggaattttcataagacgattagaaaacttggcattaggaaacattattataaattgttaccttataaaaagtttttaaaaaatgtaaatgacagatctattgtgttttttacaggtggagatctctactgttatgataaaatggctgaattaaatgccgagctacacgaagaaataaagaaagaggaagtaaaaaccgtattatttgggtgttctgttgcagaagaatttttgacaagtaaagttttgaaacaattaagtttatatgatttgattgtttgccgagaaagcttatctgtaaaaaatctcaagaaaaacggcattacgaataatgttatccagtgccctgatccggcatttgtgttggaaccggaagaagtgcctttgccaaattgctttgaaaataaagtagtaggcattaacataagtgatttagttggtgcaaacaaatcattggattcaatttatggaaataatataagaaagttagttcagtatatcttagataaaacaacatattcaattttgcttattccacatgtgacatggaaaaatcaagacgacagaacaatatgtaatgccatatatgaggagttttttgaaaatagcaaaatacaaattttagacattagttgtatgtcatattgtcagatacggtatgtgatatcaaaatgtgaaatgtttataggtgcaaggacacattcagtgatctcggcatattcgacatgcgttccgacaattgcactcggatattcaataaaatcaattggaattgcaaacgatattggcctagcatctgaactcgtgttagactgcaggaacatgaaacatacaaatgaaatgattaatgcttataaatatttagaacagaataaagataatatcaaaaattatttaaacagcaatatgacaaattataaaagagaagcatttaaagggaaggaatatttgtataaatatgttttaaataatgattttaataaagaggattgatggatggaaccaattaaaataacagataataaaaaatgttcgggttgctcagcatgttataataaatgtccggtagaggcaattgaaatgttaccagacaaagaaggattcttatatcctgaggcagataaaggaaaatgtattggatgtggactatgtgtggatgtatgcccttattataaaaaaaatatagtggaagaggataagcaactctgttttgctgcatttaacaaatctgaaaaagaacgagaaataagttcttcaggaggcatttttgttcttttggcaaaagaaatcataaaaaataatggagtagtatttggtgcagcatacgatagaaattttatggtatatcatacgggcgtggaaaattgcaaggatttattaaatatacttggctctaaatatgtacagagtaaagtgggtgacagctataaaaaagtggaggtaatactcaagcagaatagagaggtattgtttgctgggacaacctgccaaattggtggactacgttcatatttaggaaaggtgtatcctaaactttattgcatcgattttatttgtttgggtgtaccgtcaccgcaagtgtgggaaaagtatcttaaaacgttttttgatgatattaaaactgttaattttaaagataaaacaagaggctggcatcgcttctcattagatatcaaaggtaaaaacactcactttaatagagacggacgaaatacttactattttacggggtattttaatggactatattcgaggccttcctgcagtgagtgtatttttaaagagggaaatagaattagtgatattactttagcggattgttggggatatcctgttattgctccggagttggatgataacaaaggcctatccagtattgttattcactcagctaaaggaattaaattatttgaggcaattaaaaaagatttggttttaaaaaaatcggaaataaatctgattaagaaatataatgaaaattattgcaaatcagccccattaggaaatagacgagaagaattttggagtgatatggatagattaccatataaaaatgtgtgtaagaaatattgtgaacctattaaaagtgatattatatcacgaattgaaagaaagatggttgaagtgttaaaaatttacaaaaataaaagacatttgtagaattgttttgttgtttgaggatagtagatatgaattatttattgatatgctccgtaattttgattttgattatatttttattagtaaacaatttatataaaaaaacaaattattataacaatcaaattttagaaatttcgaagtatcacaaagaaaatagaaataatttaaaaattgtaaacctagggagtacctatgcacagtttgcatttggaaattatgatgagttaaaattaaatggatttagttttgccttgcaatcaaaaagtttaaaattggattataaaattttattgaagtattcaaaatggctttctgaaaagtgtgtagtaattattcctttagcaccatgcttactcctatacgagaatgatgattataagtcagatttattatattacgatgtattggggaaagatatcaataacaaatattcgtttaagcagcaaattaaacataattttccgattataggtaaccctaaaaaattgttttatattttcaaagatcaagatagatatgaaacaatatatgacaaatatcggtgtatgaggagtgaagtagcaacacatacacagatgaaggaattaacatctacctggatgaaaatttttaaattgaatgatttgaaaacgcctgatttttcagctactaatgtaaatactataacttcaaatattaaaattttaaatgaaatattagagctatgcaaaataaaacaatttaggccagttatggtaattcccccattttcaacagaattaaattcgtatttttcagatcaatttgtaaacaaagcattaacagagcatcttctaaaaatatcattaaagtttaatatcccactcattgattatagaagtgattctgcatttaaggatgccatctgctttattgatggaggattttgtttgaacaagtttgggagtcaaaagtttatgaaactactgtttaaagatttgaatgaatttggaattattgtaaataacgaaacgtcaggtttaaattaatagatactgtgccaggattaaaaagaggtggttatgcttgaaaaattgcgaaaaagattagaatatgtagagtataaaccgttgtattatactgatgaattaatgaatttatactgtaatagtacggttaccggaggtgaaatagcaggaaagtcggtattgattactggggggactggaggaataggtctggctcttgcaaaacgatttctttttgaagggtgcaatgttactatctctggaagaaatgaagagaaattaagatgtgtagtatcgcaaacagaaaaccgtcataaaggaaagctatcctatgtagtgatggatcaattaaatatcatggatcttacccaatgcgtaaaggaattgtatagtagtaaaaaatatattgatatatggatcaataatgctggtatttttactgatgaggacaaggaaaaaaaatttcgcagtattacaaaatcacaatacagaaacataattgatacgaatttgataagtacgatacaattatctaaattggttgcagaatgtatggagagtagagggggcagtattatcaatattgcatctatttgtggggtagtcggttctttcctgtatacaccatacggaatttcaaaggcaggtgtaattagtggaactcaaaaattgtctgaaatctataaaaataaaggtgtacaaataatagcgattgctcctggatctgtagcaacaaaaatggggaatttaaagataggagataatatttctaggaaatgtggtgtattaaatcgagcatccttacccgaagaaattgcttctctggcagcattcctttctaccagtacaggaaaatatgtttcgggtcaaacaattatagcatctgcatgtgaggaattataggaaagaaaaaatggtattaataaaaatttggcatgttataaaaagaataatagggaaaaagaagtatctttttccaatgtacgacagaaataattatcccataaataaaaaaacctattcgggagcatctttagaaactttgaatgtattaatagtttgtaataaccaagacgttggattagagtttgaagaaagactttgtattgaaaatgcaaattattcgttagtttttaaaacagatgactccttagacgaaaataatatgtcggtagcagcagaaaaattagttggaaaattcaataaaattattaacattgtggattttaaatctaacagtttggatatgaacataatacaatgcaaaaaaaacgactgttcagatatgtcacgcttattttaccagtggatgcagatcgaatcaaattatcttataaataataatatctatatgccaacgataacgaatgtgggcattaatttttctgattcagtggatgatactattgcaaaaggaaatacagtgagtatgattagggggctgggaacgagtcttggaaagcatggagttattgtaaatggagtacaggcttgtaaaactgtaccaataaacgttataactaaaacaacagtttatctaaatggtaaatatggttatattttggctggtgaatctattaacatgaatgagtagtataggtgtgatgagaatgaacaattcaagaacaaaaaatacgttattaataatggcgacaagtggaatcaggcaaatattgactattgttttgtcattcgtaagccggactatgtttatttattttttaggagcagaataccttggactaaatggattgttttctaatattttgtccttgctatccctttcggaatttggaattggaatagcaatcgaattttatttgtataaacctttagtacagcaagatttcaaaagaataaagacattaataaatttttgtaagacatgttatcggatggtaagcttagttatcttagtcgtaggagtttgtttaattcctattttacctaatattgttaatttagagcaagaattaccagtaaatttatatttgatttatattttatatttattaaatacggcgagtacttatttgctttttgcatataaacaaacgttattttcagcaaatcaagaacaatataaaattgaaaaaataaatattttctttactttaatcggatgcttggttgatatttttgtgttgataatttttaaaaactatatattgtatttgatttttaaaatagttgttaatattgttaaaaatctttgtatttctttaaaagctgataaagaatatccatatttacgggataaaggttatgacaaaataaaaaaaagcgaattcaaaagtttttggaaagatatatcgtctgtatttatttttaaagtgggaagtcagttaatggaagcaacagatagtattgttatttctacgattatgggaactgtaattgttggatattatagcaattattatttgattttttcccaagttcttttaatttatattttaattgttcgctcgtttacagcaggcattggtaatattattgtaaaagaaaaattgtcacatcagtatgaaatatataaggaaattgaatttttaacatattctataaatgttgttttttctgttttgctaatacagttgacaaactcatttattttttgttggataggaaaggaaaatccacaatatatattgagtcaatggattgtttttgttttaggaataaatttttatcttggatgctcaacgttgacagtaaatatttttagagaaactagcggaaagtttgaaatcgggcggaatcttcaattgatagcaggaataagcaatatttttttatcgataattttgggaaaaatgtatggattaataggaatatttttatcgaccgttattgtgaaagcatttatttcagttggtccgtttgttgttaatattgttagaacgatttttaatattgaaggaaaagaggtattattgtcatatgtaaaaaagtttgcagttttcattcttattgtgggtctttcgtggagcgttaattataatttccacatgagaacgtggatatttttaatattggaaagcgtgatgacagttataatatcgattgcgatattatttattatatacaataaattaccagagtcaaaaaatattaagaaaaggatttgcgctaagttgaaaatcttaaataaataagctgaatcatgtaattaaaatgaggtgtaaaatatgtttagccgtgtaaaaggtatagtaagagaacacaaaaaaaatagaagctggagagagaaaaatacacataactctactaacttactgtccaatgtaaacattaacaacataaccgttggtaattatacatatggcaatattaatgtattgagttttgaagatggaaaaaagttatcaattggaaatttttgctccattggccctaatgtgacatttttgttagcggctgatcacaatcttactttaatatcaacttttccctttaaagtaaaagtgttaggagaagggatggaaagcgggcctcaaaaaggaaatatagatgtagaggatgatgtgtggattggcttaaatgcaacaatctgtgcaggtgttcatattgggcaaggggcagtaatcgcagctggagccgtggttactgacaatgttcctccttatgccattgtggggggagttccagcaaaaataatcaaataccgttttacgaaggagcttattcaagagcttttacaaattgattatagtaaagtttcaaaagaggatatagaaaaaaatttaaatttattttatcaacctgtcacaaaagagtcaatagaaaagcttctggcacatttaaaaatataaaggataggtgaaaagtgaaattaaaagaatttataaaggtatcgaactatagaaaaataaaatcttacaaagagattcttgaatatgataaaaaattcaatgcatcttttctaggagaatctacatttccaaaatatttagaaaaaaaattagaatggaagacaattgagttttatagaaaatttcaagctaatcaagataatttttggggaaaatattatttaaaaaaaattgataacttagaagctaaaaccggaatacatttcgaagcaaatcctaatattggaaaaggattgataataggacattggggaaggattattcttaatggaaacgtgaagtttggtgataacatttttctgactcatggtattacaataggtagagatgtaagagggaaaagggcaggtgtgccaaccataggaaatagagtatgtattagggcaaactctacaattgtaggaaatattataattggtgatgacgtattaatagcgcctaatacatttgttaattttgatgtgcctagccattctgttgtcattggaaatccagcaactgttcatcataagagtaacgcaacagaagggcatttgggagagattatctgattctatatttaaaaattgaatatggacacaacaccctaattcatggcagaaggatcatcatctttgatgatgtaacctcgttgacgcatagtgcctgtgaagtagtcaggacttttgattctttcacaggctgtggttcaaaaaaaccgagtctgtgaaagtttttctgtaattaaagattaataaggtcttctatgataaaattaaaatcataggaggccttttattatggcaagagaaaagaaactggtacacaaagtacaaatgaccgatggaaagcgtagacatcctgatcctctgtgctgatggactgacggggatcaaggaagcgatagccgctgcatttccaaagacagaataccagaggtgcatcgtccatcaggtgcggaatatacgtatcagacaaggaccgtaagctctttgcggcagctctcaaaacgatttactaggtgccaacagtagagaaggcattagaagccttggagcgggtcactgaaaaatggtcggaagagtacccgaattctatgaaaagctggtaccagaaccgggacgcgattgtccccatctttaagttttcaacaactgtacgcaaggttatatataccacgatcacaatcgaaagcctgaacgccacataccggaagctgaatcgccagaggagcgtgtttccaagcgatacagcccttttaaaagccctgtacttgtcaacgtttgaagcaacaaagaagtggacgatgccaatctggaactggggccaggtatatggggaactgagtctcatgtatgagggccgactgccgatctaaggaaatctagaaccgttcaggacaggcgggaatccgcctgttcttgacatacgcagatatgtgcggtatatataaatcaaaggctgaacgctcatagagaagctttcagccctgctattatcatggaagctctgcttttacagagatttcttcacacactcaaaaatttctcgctgaaaaattctcccccctccctcttgccagttcccccaaaaaatgctatattctactagactgacaaactatgcccaaatctcgccctatatcagactgcagcggatttcagtaatcaaaacagggcatattttttaatagaagcagtgtagttcggcctacacccatcacaataatcacaacccaaagaaaagaggaacccacccatggcaatagttgaccaaagcaaaatcagaaatttctgcatcatcgcccacattgatcacggcaagtcaacccttgcagaccgaattatagagaagactggcttacttaccagcagggagatgcagtcccaggtacttgataacatggacttagagcgtgagcgtggaatcacgatcaaggcccaggcagtccgtaccgtatatacatcgaaagacggagaagagtatatcttcaacctcatcgataccccaggccatgtcgatttcaactacgaggtatcgaggagcctcgcagcctgcgacggagcgattcttgttgtagacgccgcacagggaattgaggcccagacgctggccaatgtataccttgcactcgaccacaacctggatgtatttccggtaatcaataaaattgaccttccaagtgcggaaccggatcgtgttgccgcagagatagaggacgtaatcggaatcgaggcccatgatgccccgagaatttcagctaaaattggtttaaacattgacgaggtcctggaacaaattgtcacaaagattccggctccccagggagacgcggcggcgccgcttcaggcattgattttcgactccctctatgactcctacaaaggcgtcatcgtattctgccggattaagaatggaagtgtccgcaaaggcacccagattaagatgatggcgaccggagccaaggcagatgtggtggaggtaggctacttcggagccggccagttcattccctgtgaggaactggaagccggtatggtaggctatatcacggccagcatcaagaatgtcagggatacgatggtgggtgatacgatcaccgatgcgcagaatccctgcaaagaacccctcccgggatataaaaaagtgaccccgatggtttactgcggtctctatccggccgacggcgcaaaatacccggatctcagggatgcactggaaaaattacagttaaatgatgcctccctgttctttgaaccggagacttccattgcgctcggttttggtttccgctgcggtttccttggccttctgcacctggatattatcgaagaacgtctggaacgggaatataacctggatttggtgacgacggctccgggcgttgtataccgtgtccacaagacgaacggagagatgatggagcttaccaatccgtccaaccttcccgacccatccgagatagaatatatggaagaacccattgtatcggcagaaatcatggtaacgacggaatttgtcggtgctattatgacgttgtgccaggaacgccgcggagtctatctgggcatggaatatattgaggcgacaagggcgcttttgaagtatgaacttcccctcaacgagattatttatgatttctttgacgccctcaaatcgcgctcccgcggatatgcgtcctttgactatgagctgaagggctacgaacagtccaagcttgtaaaactggatatccttgtgaaccgcgaggaagtcgatgccctttcatttattgtattcgaaggttcggcttatgagcggggcagaagaatgtgcgagaaactgaaggacgagattccgagacaccttttcgagattccgattcaggcggccgtgggcggcaaaattattgccagggagacagtcaaagcgatgagaaaagacgttcttgccaaatgttatggaggcgatatctcacgtaagagaaagcttctggaaaaacagaaggaaggcaagaagagaatgcgccagatcggaaacgtggaaattccgcaaaaggcattcatgagtgtgctgaagctggacgaggaatgatgttccggcaaaaatcattaaacaatcaggcgggaacaatggaaaataacaccccattagaactatatatccacatcccattctgcgttaaaaaatgtctgtactgcgacttcctttcctttgcggcggacgaagtgaccagaaaaaaatatgtggagcagttgattaaggaaatagaaacatgcgggaccagaataaccgggcgggacgctgacgcggccttcccggtgatttctgtgtttataggaggggggactccgtcttctctctgcccggagcagatttgcgctgttatgaacgcggtaaaggaaaatttcagactattgccggatgccgaaatcaccatcgaagccaatcccggtacactcgacaataaaaaactcagagcttacaaaaactccggaatcaaccggttaagcctcggccttcagtcggccaatccaggcgaactgagggagctcggacgaatccattcctggaacgaatttcttgagagttaccgtttagccagagaagcaggctttgataatattaatgttgatttgatgtcggcactgccgggacagagctttgaatcttatgcggatacactggaatgtgtcgcgctcctggaaccggaacacatctctgcatacagtcttatcatagaggaaggcactccgttttatgataaatattcgggcagggcagaagttcttccggatgaggaagaagaccgcagaatgtatcaccacacaaaagaatatctggcggaaaaaggttatcaccggtatgaggtatcaaactacgccaggccgggcagggaatgtatccacaatgtgggatattggaccgggggcagctatctgggaatcggtctgggagcttcctcactgatggaaggacaacgtttttccgtcatcagagagatgaatgattatctggatcttagcagggaagagctggcggagggccgccagtacgaaaaccgggaaatcctcacggaacaggatgagatggaagaattcatgtttctgggtcttcggcttacggaagggattgccgcaaaagattttaaaaagcgcttcggcttaaatatagaagaaatatatggaatgaccattgggaaactgatggaggacggcctgatggaaatgacgggaacaaaagaggacagaaggtacaggctgagtgaatttgggctggatgtcagcaactgtgtactggctgaatttctgttgtagcggaaatctttcgttatcattaaaatcactgcgcgatagccggctgccggctgccactaccttttcgcacagtcagcgcagcaaatgcgcagacctgactgaattgttaccggcacgccgctttttggcagggggtggacagtaaccagcagcaatctttacaagtatcagtgtatttgttattatagattgagtttcactgtattattaacagtactgcaataagagcaatatggaagagaaataaagaagagaaataaagaagagtaataaaaagagtttcatctgggaggaaatgagtaatggaaatcacaatgacgcactatctgattgtttgtcccctggtttttctggccggactgctggattcaatcgcaggagggggcggactgatttccctcccggcctttatgattgccggagtgcctccacacatggcccttggaacaaataagatgtgttctacaatgggaacctccatggctacataccgttttgcaaagaatggctacattcacctgaaaaaggtaatctggttcattgcggcggcattggttggctctacgatcggttccaacctgaccctcttaatgaatgaaaagatagtggagtacatgatgatcgccgtgcttcccattgtcgctttctatgtgctccgcaataagaggatgggagatgactcgcaggcagggacgataccggctaaaaagtcatttatcattgcggctgcagcggctttggtagtcgggacttatgacggtttctatggtccgggaacaggaacctttttaatcctcattcttacgggcgccgcaaaatatacgatgaaagaggcagcggggacaacaaaggccatcaacctttcttccaatgtcgcggctatcgtcacattcatcataaacgggaaagtattatatccccttggtctggcagcaggcctgtgcagcattgtgggaaattacatcggttccggcctggtgctctcgaacggtcagaaaatcgtgcgtccggtggtactgattgtactgaccatcctctttggtaaaattttactgggaggatgacacaggtagtcagtacgtaacagatgaagttactgttcacgggtagtatcccgcgaggtgttttcgtgtgcagtttgtacgaaaattccgagttacacggcacgacgcggtgaaaagtaaatttttcaccacaatcaacggcgttttctgccgtttctgtgcatcgcggagcgtgttactggccgcagaactgcgcttttggcagggctgcgaacagtaaccggttgacatgaatttgatatttggcatataaacagcaaacaaaaaagaacggatataacggagtaaaatccggcgtatttatggaggaaatcttatgaagtggaagaaattcaccctgacgactacgaccgaggccgtagatttaattagctgtgccttcgatgaaatcggaatcgagggtattgaaatcgaggataatattcctcttacggaaaaagagacaaaagggatgttcatcgatatactcccggagctgcctcccgacgaaggaatagcgaaagtcagcttttatctggacgatgatgccgatgtaccgggcatgcttgaaaaagtaaatgaagcgctggaagaattgaaaatgtttaccgacctgggcgcatgtacaatcgaggcatcagaaacagaggacaaagactggattaacaactggaaacagtattttaaaccatttacagtggatgatatcctgattaagccaacctgggagacgattcctgaggagcataaggacaagctgctgattcagattgatccgggaactgctttcggcacaggcatgcatgagacgacccagctgtgcatccgccagcttcgtaaatacacaggcagtgacacgaaggttctggatgtggggacaggaagcggaattctgggcatcaccgctttgaaactcggggcgaaagaggtattcggaaccgatctcgacgagaacgccatcacggcagtgggagaaaatcttgaggcaaacggtatcccggccggattatttaccgttcttcagggaaatatcatcgatgataaagaggtacaggacgccgcaggttatgagtactacgatgtggcggttgccaatattctggctgatgttattattatgctccagaaggaaatcccggttcatataaaaaaaggtggaatttttatcacctccggtatcattaatatgaaggaagaggtggtcaaagaggcttttgcagccaacagcgcctttgaaatcattgaggtgacctatcagggagagtgggtatccataacggcgcgtaagaaataggtaacagttcatgctgtctgaactgacacagaatatagaggaaaaacatgtatcatttttttgttgaacaggaacagataggggaaggcgtaattgcggttaccggacccgatgtaaatcatataaagaatgtactccggatgaagccgggagaacgggttcttatcagtgctaaggccggcggtgattatctgtgtgtaacaaaagaactggcgcaggacaagatcctgtttggaatactggagaagagtgagagtgaaatggagctgcctgccagaatccacctgtttcaggggcttcccaaaggtgataaaatggagctgattatccagaaggccgttgagcttggcgcattcagaatcattccggttgagacaaaacgggtagtggtgaagcttgattcgaaaaaagaagaggcgaggataaagcgatggaacgcgatatctgagagtgcggcgaaacagtcaaaacggagcatcataccggaagtaacaggagttgttaaatacaaggatgctctgcagatggcagaagactttggacttaaaatgattccgtacgaatgcgcaaagggaatggaggagaccagacggcttcttcagaccgcggaagcgggaatggatattgccatatttatcggaccggaaggcggctttgaagaagaagagatacggcaggcaggggagaggggagtcagccctgtctcgctcggcaggagaattttaaggacagagacagcgggcttgtgcgttttgtcggccctgatgatttctctggaccgttagacgtccataaagcagaaagaggaagaaaaatggaagcttattttgataattcggctactacgcaggtttttgactgcgtaaaagacgcggtagtaaatgccatgaccatggactacgggaatgcggccgcccgccatatgaagggcgttgaggcagaaaagattataaaagaagccagaagagagatagccaattcgctgaaggttcaggaaaaagaaatcctgttcacatcaggaggaacagaatcgaacaacctggcgctgattgggacggccctggcgaatcagaggacaggaaaacatctgattacaagcgcggtggaacatccgtccgtatataatacaatggcctggctggaggaacagggctttgaaattacctatcttccagttgattcctttggctgcatttccctggcggagcttgaggaggcggtaagggaagatacgattttggtatccataatgtacgttaataatgaaatcggcgctgtggagccggtggaggagattgcccgctgcattaagaataaaaacccaaaaacctattttcatgtggatgcaattcaggcatacggcaaatttcagatacgccctaaaaagcaggggattgatttgctgtcggtaagcgctcataagatacacggtccgaagggaatcggctttttatatattgatgaaaaagtaaaaatccggcccattgtattcggtggaggtcagcagaaggggatgcgctccgggacggagaacgtgccgggctgtgccggactgggggcagccgtaaaggagatttataaaaatcatggggagcgggttgagaagctgtatacactgagggaacgcctgattgccgggctgaagacaatcgatggtgtgacgattaacgggcatgaggacagacaaaatgctccccaggtggtcagtgcaagctttgaaggaataaaaagcgaggtgctgctccatgcgcttgaggacaggggaatttatgtatcatccggttcagcctgctcctcgaaccatccgggagtgagcggaacgctgaaggcgattggcgtaaaaaaagaattgcaggattccacactgcgtttcagcttcggcgcattcaatacggaagaagaggttgattatgcagtagatgtgttgaaagaactgctgcccgtactgagacgttacagagccagataaggttaccatttaacagataaggaaacagagaggaaatataaacatatggtacgttcatttttaataaaatacgcggaaattggggtaaaaggcaagaaccgctatatttttgaagacaagctgacttcccacatccaccattccctgaaacgtctggacggagatttctccgttatcaaggagtcgggacggatttatgctcatgcatcttcggagttcgactatgatgaggtggtatcggctcttcagtgtgtgttcggaattgccggcatctgtccgatggtgcagatagaagataaaggatatgaggatttaaaggaacaggtcctgaaatttattgacgagacgtaccctgataaaaatttcacattcaaggtggatacgagaagggccaataagcagtacccccacacgtcggatcagattaaccgcgatttgggagaaatcattctggagacatatcctgagacaaaggtggatgtgcatcatcccgacgtacttctccacgtggagatcaggggaaaaaatataaacctttactccctggtaatcccaggcccgggcggaatgccggtgggaacgaacggcaaggctatgctgcttttgtcgggcggaatcgacagcccggtggccggatatatgattgcgaagaggggggtgacgatagaagccacttacttccatgctccgccgtatacaagtgagagagccaaacagaaggtgatagacctggcgaagctcgtatccagatactcgggaccaatcaagctccatgtagtgaattttactgatatccagctttatatctatgataaatgccctcatgaggaactgacgattatcatgcgccggtatatgatgaagattgcggaggagctggctatgaaagacggctgtctcggccttatcacgggagagagtatcggacaggtagcttctcagacggtgcattcgctggctgtaaccaatgaagtgtgtacacttcccgtatttcgtcctgttatcggatttgataagcaggagattgtggatatatcacagaaaatcggaacatttgagacgtccattgagccgttcgaggactgctgtacgatttttgttgcaaagcatcctgttacaaagccaaatctggatttgataaagaagtcggaaacaaaactggaagaaaaaattgatgaaatgttgaaacaggctgttgaaacagccgagattatacggtgttgagaaaacgggagtccggattttgggactcccgcttaggaaaaactatgttgaatgggacgtgcttttcagcgttaaaacagggcgtatttgtttaaacgatatatggtgctaaaattgtgagaatgtcattgatctctgtttcggaatggatgttcaggtcgataggcttggacaaatccaggctgaatatacccataatcgatttggcatcgattacgtatctgccggatacaaggtcaaaatcgacattaaattttgctaaatcgtttacaaaagatttaactttatcaattgaatttaaagaaatacgaactgttttcatgaaaaaacctcctcttgctactatgttatttcagctcttatgctggtaaaatactaactctatactaccgggatatggagcaaaagtcaagagagagattgtatgaaatcaggaactttaaagctaaggagaatgacaatgagaaaagcagcactgcacaacctaggatgcaaggtaaacgcttacgagacggaagccatgcagcagctcctggaagatgccggctatgaaatcgtgccttttaaggatggggccgatgtatatataatcaatacatgttccgtaactaatgttgcggacaaaaaatcaaggcagatgcttcaccgggcaaagaaaatgaatcctgattccgtagtggttgccgtgggctgctatgtccaggcagcgaaagaggatctggagaaagacatggcagtggatttgataattggaaataacaagaaaaaagatctggtgggtcttctggaacgatattttgcagatcgggacgacagggaggaagtgatcgatatcgcggcaaccggtgagtatgaggaacttcatatccggaaaatcgcagatcatacaagagcctttattaaagtgcaggacggctgcaaccagttctgcagctattgcatcatcccatatacccgtggccgggtgagaagccgggcgataggggatgtggtgaaggaggtggaaggacttgcgggggccgggtataaagaaattgttcttaccggaatccatctcagttcctacggcgtcgattttccggaggagaagagggaaaatcttctgagtcttatcacctgtctggataaaatccagggaattgaaagaatccgcctaggttccctggaaccgcgaatcataacggaagaatttgtttcggctctggccggtcttaagagcatttgccctcatttccatctgtccctccagagcgggtgcaatgcaacgcttgcaaggatgaaccgccattacactgcgcaagagtatttggagcgctgtgtcatcctgagaaagcactttgataatccggcgatcacgacggatgtgattgttggatttccgggggagaccgtggaagagtttgatgagacgaaaagattccttgagacggtccgtttttatgaaatgcatatctttaaatattccaagcgggagggcaccagggccgcagtcatggaaaatcaggttccggagcaggataagtcggtccgcagcgatattctcctaacattggaacataagatgtcggatgaataccgtgagtcatttctcgggaaagagacggaggtgctgctggaagaaaaggtcgtgattggcggacaggcctatatgatgggacatacacggcaatatgtaaaggcggcaataccgtttgaggaagggcttaagaatacaactgtaaaaggaaggctgacggagaagctgtcggatgagattttgcttttgaaatgaggatttagttaagcaggtgaggacgccgccggtacggccagcggacggggggggtgggtggtgtatatgagtctttcgtcccgggggaagattgtcgtggtatggggctgcgggcgaagataaagtctgcggagcacgctcccgctctgtgaaatgcatcacgctgctaagctcggcaggacctcgctaatcagcgatggatttcaacggcatccgcagactttatcttcccctccgccccaaaaccatgttttcgccgggacgaaagactccgccgggtgtatcggccccgtccgctggcctgcggccgctgatagtctcacgcgttaagtgcgggggcggaccttgtcgaggccactcagcgcttccgtgtgcgggaaatacgatataccttcaatgcgcatttttatataattgcggaaggtttgatttcagtttgccggaaacacgtggtggccgcgacagggtcctccccatttaaggttagagacaatcagcgcccggaacggaccatgtccggtgtcgaaaacctccgcctgagtgttccgtccccggcgcaaacctgatccggggaagtaggcggaatcaattgcggaggggacatgggagtccgccggtgcttggcgaggttcctcacgagcctagaaccgatgcgcactccaaagagtgcaaacggtccccgcagcaattcattccggccggattcccccttcacgacaacctacccacggggacggaagactcagacagactcccccaccacaccggacatggtccgttccggacgcgtcctccaacctcagttaaatctccatttggtatcgtgaaaatttcccttgccgaatattggtttttagggtagaatagatgagagtagtttaaaggacgtgaataagatcatgggcgatatcagtaatacacaattttttaaagcagtacaggaagagaagaagctggaagtaagccaggttttagagcaggtttatgtcgctctgactgagaaggggtacaaccctatcaatcagatggtgggatatataatgtctggagatccaacatatattaccagccacaagagcgccagaagcctgattatgaaggttgagcgtgatgagattctggaagaactgatgaaagtttatgtggagacaaaactgaaataatcaagcggcaggggacaacccctggcggaaggttttgggcgatacaggattttttgcagtgcggcgcggggaaatgtgcgcggcgcagacttttcagaatggacaataacaggattccggagtatacgacagcgtaagaatgataagagaggcaggacagttggcaatatgccagcttgttttgttatgggtaaaacagcttatgagagtacttggactggattttggttccaagacgaccggggtggcggtcagtgatccgctgggttttacggcccagggacttgagacaatcacccgggaggatgagaacaaactgcgccgtacctgtgcgcggattgaagaattgattcgggaatatcagattgaaacgatagttttagggtatcctaagaatatgaataacacatcaggagagcgtgtggagaagactcttgcattcaaagaaatgctggagcgccgcaccggtctgtctgtgattttatgggacgaacgtttgactacgactgctgcagagcagattttaatagaaagcggagtgcgccgcgagaacaggaaagcagtgattgataaagttgccgcttcccttattttgcagggctatctggactcattggctatcagcaaggtaaatacgcagccggagaagtagtgcggcaggcggccgggagtccggcgcctgcgggcaggaaaggaagaacaggatggatacgtttgacaaaatcatggaaaatagtgatgatatgattacgcttcagacagatgacggagaaactgtcagcttttatgtactggaagagactaagatgaatggggaaacctatcttttagtgagcgattcgaaagaagaagacggcgactgctatcttttgcgggataaatcaaaaccggaagacccggaagcatcttatgaatttgtggacgatgacggtgagcttgattatatgtccaaaatttttgaagagcttatgagtgatctgggagttgaaatcgaaaaataatgaaacggaaaataaagacatacggaggtgcaatctttgaaacaagagaataaacataataaggtaaagatcattccactcggagggctggaacagatcggtatgaacatgactgcctttgaatatgaagacagtattattgtcgtggactgcggtctggcattccccagcgacgacatgctgggaatcgatctggtaatcccggacgtgacctatttaaagaataatatcagcaaagttaaaggctttgtaatcactcacggacatgaggatcacatcggagccctgccatacgtcctgaaggacatcccggccccggtatacggaacaaagctgacaatcgggctgattgacaataaattaaaagaacacaacatgacaaagacgatcaagcgcaaggtggtaaaacacggccagtcaattaatctgggctgctttaggatcgaatttgtaaagacaaaccacagtatcgcggacgcatctgccctggctatttttacgccggcaggcattattctccacacgggagactttaaaattgactacacgccggtattcggtgagccggccgatcttcagcggtttgcagagcttggcaaaaaaggtgtgctggcccttatgtgtgacagtaccaatgccatcaggcctggatttacgatgtctgagcggacggtgggacggacctttgattccatttttgccgagcataagaacaaccggattcttgtggctacctttgcctcgaatgtggaccgtgtacagcagattatcaattcggcttacaaatacggaagaaaagtagttgtggaaggccgaagcatggtcaatgtcatcggaacggccagtgaactgggatatatcaatattccggaaggaacgctgattgatatagagcatctgaaaaattataagaaagaagacacggtattgatcacgacgggcagccagggtgaatctatggcggcattgtccagaatggcggcaagtcttcataaaaaagtatccattatgccgggagatgtggtaatattaagttcaacaccgattccgggtaatgaaaaggcagtgtccaaggtaatcaatgagctttccatgaagggagctgaggtgattttccaggatacccacgtatcgggacatgcctgccaggaagaaatcaagctgatgtattccctgatacgtcctaaatacgcaattccggtacacggcgagtaccgccacctgatggcgcagaagggactggccgaatccatgggaattccgaaggaaaatgtaattatcatgtcttcgggcgatgtggtggagattggcgatgagggctacaaaattgccgatcatgtacaggccggagggatactggttgacggtctcggaattggcgacgtgggcaatattgtcctgcgtgaccgtcagaacctggcgcagaacggtattatcatcgttgtgcttactcttgaaaaatacagcaaccagcttatggcaggaccggacattgtctcaaggggatttgtctatgtcagggaatcagaggatttgatggacgaggcccagaggattgtagacgcggcggtacaggactgcctgaggcgccatgtcagcgactggggcaagattaagaatattatcagggacagcttaagtgatttcctttggaagaagatgaagagaaatccgatgattctgccgattattatggaagtgtagataaaagctgcgtgttatacagtgtgaagcagtgtcggcgttactatttgtagaaccgcgtttttttgcggcgctgtgaatagtaacgtgtttacaccgctaatgtaccagacaggagttactgcatatgagccggacaaccagagaaatcaacaggataacgactacaataatcagcatgtccgtcaggctgttattctatgcccttgtattttttcttctgtatgagggaattacgagaggctacagtctgggacatgaagtcttttcgcctacggccgtagctgtggcgccgggaaccgacaaagaattcactatcaggaatggtgaatcactgtccgaggttgccgaagagctggagaaaagcgggctgattaataataaactgatatttattatccaggctaaattttttgattatgaagtgtatccggggacctatacgctgaatacgtcgatgacatccagagatatgatgaaagcgattgatgagagcggtatagagcgtaagaaagctgctgaaagcagcgccgctgccagtacctcttccgggagcagcggggagagcggtacggccggcagcagcgctgagaataacggcagtgacgaaagcggtgaaaccaccggtgaaaacggtgcatcccgggaagacggggcggccgatgaagatggagcttatgtatcatgatagtaaatgagaggataaccgcatacatcaattctttagataggggaaacggcagtctctgcgatgaagtggaagaggaggctgtttcttcttatgttccgattatcaggaaagagacatcggctctgttaaagactcttgttgcgatgaagcggccggagagaatactggaagtgggtacggcggtaggctattccgctcttttaatgagccgtgtaatgccggaaaactgtcatataacgacaatagaaaaatacgaaaagcgtattccgatagcaaaagaaaattttataagggcaggggaagaggagcggatcaccttactggaaggtgatgcagaagaaattctgggatcactttccggcccttatgattttatattcatggatgcggccaagggacaatatctccactggctgccggtcatgctgaggctgcttccaaagggcggagtcctggtatcggacaatgtactgcaggacggcgatattatcgagtcccgctatgcggtggagcggagaaacaggacaatccatgcaaggatgagagagtatctgtataccctcacccatatggaggaatttgagacatccataatccccattggggacggtgttacaatcagtgtaaagaaatgaggagctgaattatgagaaaactggagcttttaatccctgccgggagtctggatgtattgaagactgcggtgatatacggagccgacgccgtttacctgggcggagaggcgtttgggctgagggcgaaggcaaagaattttacaaacgaggaaattaaagagggaattgcttttgcacacgaaagaggtgtcaaagtttatataacggcaaatattctggctcacaatgacgatcttcccggggtggaacagtattttgaagagcttaaggaggtaaagccggatgccctgattatatcagatcccggtgtgtttgccattgcaaagaaaatcctgccggatatggagcttcatatcagtacccaggccaacaatacgaattacgggacttatttattctggtacggccagggggcaaagcgggtggtgactgccagggagctgtctctcgccgagattaaggaaatcagggagaagattccggaggacatggagattgagagcttcatccacggcgccatgtgcatttcctattccggccgctgcctgctaagcaattattttgtgggcagggatgccaaccagggggcctgcacccatccgtgccgatggaaatattcggtggtggaagagaccaggccgggtgaatatatgccggtgtatgagaatgagcgcggaacctatatctttaattccaaagacctgtgcatgattgaacatattccggaaatgattgatgccggcatagacagcttcaagatcgaaggcaggatgaagacggccctctatgtggcgactgtagcacggacctacagaaaagcaatcgacgactatctgaaaagtccggagctttacagagagaatatggagtggtataaatcggagattggtaaatgtacgtaccgtgaatttacgaccggattctattttcacaagccggatgccacgactcagatttacgacagcaatacttatgtgaaaaactatacgtatctcggtacggtggaggcagtacgggaggacggcctggtacgcatagaacagaagaataagttctctgtgggcgagacggtggagattatgaaaccggacggccggaatctggagaaagaggttgcggccatctgcgacgaggaaggaaatccggtggagagcgcaccccacccaaaacaagttctctatgtggatttgggggcggatgcagagtgcggcgatattatccgcagaagtgagatggaggcggactagattaagacatgctctacgaaggaggaaaaccatgacatggattttggaaggtgctgcaattttatgtctgctttattatggggtaattgcgctgtattcaggcctgtcgacttcatttgccctgatatggccgacaatggcaatatttttcgtactcctggcggcgggactgcactattaccaccggcatccccagtctgtgcctcagtggctggtggtatcgactgccacattctgcacagcatgccttgtcatttttgtcgcggtggagctgctgattggatggagcgctgtcacctccacgcgccgggcggcggaatatgtgatagtgctgggagccaaagtgaggggaagcgaactgagcaattctcttaagaaaaggctggacaaggcgcttgaatatgcggagaataatccgaataccgtactggtgctttccggaggaaaaggggagggcgaagatatcagcgaagctgaggccatgtatgattatcttcagtataacggcataccggagtcccagctgcttctggaagaacagtccgtcaatacggtgcagaacattgttttcagcaaaaaggtaattgattatcaggaaaaatataaggcgatggaggccagggaaagcctgcttgacagctacaaagaaagatccgactcggtcaaaattgcggttctgaccagcaattaccatgtgttccgggccaaatccatagccaggaaacaggggatttacaacatatcgggcatagctgctcccggagatcctgttttggccatacatatgtgggttagagagtgttttgctgtactgaaagataaatttatgggtaaaatgtaagaaagtgaagaaactggttgctggtcacatcactgcgctttttggcagggctgtgaacagtaacagaaactgttcatctgaacggttagcagtgaaaataaaccaatcaggaaaaggaagatgagaatgacagtgaaggaattagacgcctatcaggtaataagtgaaaaatatgtaaaagaactgaattcggagggaataatcctggagcataagaaaacgggcgccaggattttcctgctttctaatgaggacgaaaataaggtgtttacgataggattccggactcctccgtccgacagcacgggagttccccatattctggaacacagcgtactctgcggttcggaaaagtttccggtgaaggacccgtttgtagagctggtaaaaggctccctcaatacatttttaaatgcaatgacatatccggataagacggtatatccggtggcaagctgcaatgacaaggatttccagaacctgatgaacgtctatatggatgccgtacttcatccgggtatttataatgaggagaaaatcttcatgcaggagggatggcactatgagctggagtcggaggaaagccctctcgtctataacggagtagtctacaatgagatgaagggagcgttttcctcgccggagagcgtgctggaccgctatacgagaaatgttcttttcccggatacctgctattccaacgagtcgggaggggctccggatgcgattccatcactgacctatgaacagtttctcgatttccaccgcagatattatcatccgtccaacagctttatctatttatatggggatatggacatggcggaaaaattagactggctggacagagaatacttaagccggtatgacagacagccggtggattccgccatccatatgcagaagccattcgagaagcctgttgagcgtgagatttactattccatcacagagacggagccggaagagcaggcgacttacctgtcagtcaatacagtagtgggcgatgacctggatccgatccattacatggcatttcagatcctggaatatacactgatagacgcgcccggagcgccgctgaaggaagaactggtgaaagcaggtatcggccaggatatccttggcggttatgaaaacggcattttgcagccttacttctccgtcatagccaaggatgccgacagggaacagctgggggaatttcttgctgtcgtcaaagggactctcagaaagctggcggatcagggaatcaacaggaagagtcttcttgccgggataaattattatgaattccgatacagggaagctgatttcggctcagcgccgaagggactgatgtatggccttcagagcatggacagctggctttatgacggtgatcctctgatgcatctggagtatgaaaagacttttgaattccttaaaaaagcggtggaagagggctactttgagaatctgattaagacctgcctgctggataacccctttgaggcagtgattacggtcagtccgaagagaaacttaacggccatcgaagatgaaaagctgagggaaaagctggctgaatataagaagagcctctctgatacagagattaagacgctgattgaaaaaaccagagaacttaagctgtaccaggataccccgtccccgaaggaggagcttgagaaaatcccattgctgaaacgggaagacattgaagaacagccggaaaagctctgcctggaagtaaaagagattgataatacaacggttctggctcataatatgttcacatccggaatcggatacctgaaggtgctgtttgatacaaaccgggtgccggcggaggatctgccgtatgtcggccttttgaaatcggttctgggctatgtgaatacaaaggagcatacctacagtgatcttgccagcgaaatctatttaaacagcggcggaatcagcctgagcgtgacgtcgttcccgaacctggaagaaccggaaaagtttaccggggcattcacggccagcgccagagttctttatgaaaagctggatttcggtttttctctgatcggagagatgctggcggattcgattcttgacgacgagaaacgtctaagtgagattgtggcggagatgaagtccagaagccaggcaaagctgaattctgcggcacactctgcggctgtggcgagagctacctcttacttttcggcaacctcggccttcaatgatattacgggcggaattgcctattatcagttcctggaggatcttgcaaggaattttgaggacagaaaaacagttctgatgcagaaattaaaagagacggcgggccgccttttcactgcggataacatgacggtaagctatacggcggatgacgagggattcagatatctggcgcccgccatgaagcttttaaaagagaagctgcctgagacaggcggtccgtcatatccgtttatttgggaaaaggggaaccggaacgagggctttatgacttcctcgcaggtcaattatgtggccaggtgcggaagctttgcagagagcggctatgcctatacaggagcgctgcgggttttgaaacctatcctgggttacgattatctctggctgaatgtcagggttaaaggaggcgcttacggagtcatgaacagcgccggccgttccggtgaaggttattttgtatcctaccgggatccgaatctgaaagagacggatcaggtatttgaaggagttgcagattacctggaacagtttgacgcggacgagagggatatgacaaaatatgtaataggcaccatcagcgacatggatacgcctctgctgccgccgtataaaggcgccaaggcggtatcggcctggtattccggcattacggatgagatgctggcagaggagagaaggcaggtgctggccgcacagccggaggatatccgcgcacttgcgaagattatcagagcgattttgtctaccggaagcttttgcgttgtcggtaattcagagaaaatcaaggaaaataaggagctgttcggcagcataaagaatttgtttaattaagtctgcaccgcgtttttcagcggtgctgtgaatagtaacatggagttattgaaccgttacccgaaactatacagaagagaaacaaaaaacggtttggatgctgcagtccggcttatggcaaaactgcagcattcgcaaccggaaaattgaaggagtttgaatgcaggataatttaaaatcaggatttgtaacattaatagggcggccgaatgtgggaaaatccacgcttatgaaccatctgattggacagaaaatcgcgattacgtccgacaaaccgcagactacaagaaacaggattcagaccgtatatacggatgagagggggcagattatctttctggacactcccggtatccacaaagcaaagaataagcttggggaatatatggtcagcgttgccgagcatacgctgaaggaggttgacgtcatcctgtggctggtggagccgtctacgtttatcggagcgggagaacgccatatagcggagcagcttaataaggtgaagactccggtgatgcttgtaataaacaagattgatacggtaaaaaaagacgagattctcacctttatcgcggcttacaaggacatctgcaattttgcggagattataccggtgtccgctcttaaggaaatcaatatcgatgatgtaaaagactgcattttcaaataccttcccgaagggccgcagttttatgatgaggatacggtgacggatcagccgatgcgccagattgcggccgagcttatcagagagaaggccctcagaatgctggacgacgagatacctcacggcattgccgttgtcattgaccagatgaaggagcgtccgaacggactgattgacatcgacgcaaccatcgtgtgcgagcgtgaatcccataagggaatcattatcggaaagaacggcggaaaattgaaaaaaatcggaacatccgccaggacggagatacagaatctgatggacacccaggtgaacttaaagctttgggtgaaggtcagaaaagagtggcgtgacagcgatctctatatgaagaattacggttacaatccgaaagacatataggttactgtatattgaacgttactttttacacccctgccaaaacgcggcaatgctgtgaaaagtaactatagaactgcatttcaacaaaaaagtcaggaggcggaggtttgagggaattagttaaaatcacgggtatggtgcttagcgcatttccggtgggtgaatacgacaaacgtcttgtcatcctgacaaaagaacggggaaaaatcacggcttttgcgagaggggcaaaacggccgggcagtctgcttcgggcgcccagccgtccctttgcttttggcacattttccctggcggaggggcgggacgcctataatctttatggggcggagatagaaaattattttgaagacctggaaaaggatatggagtgcgcctgctatgcctcttattttgtggaatttgcggactactacgagagagaagggatcgaggcgacagaaatgctgaagctgctgtatcagtcgtttcgggcccttctgcggcccgcgattccaaacaggctggttcagcggatttttgagctgaaggctatgtcgctcaacggtgagtatacggagcgtcccggcagggcagccggcgaatcggctgtgtacgcctgggaatatgttattttctcccctgtggaaaaactgtatacctttctgctcaccgacgaagtgtttgaagaattcaggcggtgtgtcgaggataacaagaaacgctacatagacaggaaattccattcactggagatcctggatgccatcgtatgaatcgcaacggttcatgctgtctgaactgtcattatgaacgggggtgaaaataccccgcgggccgctgcccgtggacagtactgaattattactgaataaatacctggccgcctattgaaaataaaggaaaaagaaggtatactataaaaacttgatgcgaaatgaaagggaggatgagtgatgaaaaagtccggactgctgttagcggcggctgccgtggcaggaatgctgctgacaggctgcggtgcaagccagaaaagtacattctctccgtccgtaagctgtgtatatgtggcgcaggatggttctgtttccagtgctctggtgaaagaatacgagggagatactgttaacagcaaggatctccagcagtacctggaggctgccgtcatccggtttaaccaggagaacggtgcgcaggggatggcggagaataagatgggagccgataagctgccggcttcgcttcagagcgttacggcggataaaggagttatgaaggccgtatttgattatgcttccctggaggatttgattaaattccgccagacggaggataacgaggatacaagcaatacggttacagcgctggaagtcagcaaagtggcagatgccgatgcggccggatggcttgcagagggacaatttgtcaaggcggacggaagtccggcctcggcagaggagataaaatcagacgcggctgcgtcggctgcccggattagcggcggaggcaatatcatgttttccggaaaggttctctatatgacggagggcatagaaaagaaggatgaatacacggtgacggtgccggagggcgaaaatgcccttgttgtgttcaaatagataggaggataaatttaaagatggaaaagacaatggaaaagattgtagctcttgccaaatcaagaggatttgtatacccgggttctgagatttacggcggacttgccaatacatgggattacggtaacctcggtgtggagctgaagaacaatgtaaagaaagcctggtggcagaaattcgtacaggaaagcccgtataacgtgggtgttgactgtgctatacttatgaactcccagacatgggtggcttccggccatctgggcggtttttccgatcctcttatggactgcaaggcatgtaaagagcgtttccgcgccgacaagctgattgaggactatatggatgagaagggaatcaagattgaaggttccgtagacgcatggtcccaggaagagatgaagaaatacatcgatgacaacaatatctgctgcccaagctgcggcaagcatgattttaccgatatccgccagttcaacctgatgttcaagacattccagggcgtaacggaggatgctaagaataccgtatatttaaggccggagacagctcagggtatttttgtaaactttaaaaatgtccagagaacctccagaaagaaagtaccgttcggaatcgcgcaggtgggcaagtccttccgtaatgagattacaccgggtaactttaccttccgtacgagagagtttgagcagatggagctggaattcttctgtgagccggatactgatctcgagtggttcgcttactggaaagaatactgcattaactggctgaaagcgctcggcatcaaggaagacgagatgcgcgccagggatcatgagcaggaggagctgagcttttacagcaaggccacaacggatatcgagttcctcttcccattcggctggggcgaactctggggtatcgcagacaggacagactacgatttgacccagcaccagaacacatcgggacaggatatgacctacttcgatgatgagaagaagattaaatatatcccatatgtaattgagccgtcacttggcgctgaccgtgtgacgctggcattcctctgtgcggcttacgacgaagaggagatcggagagggcgatgtaagaaccgttcttcatttccatccggcgatcgctcctgttaagatcggcgtgcttcctctgtccaagaaattaaatgagggcgcagagaaggtgtataatgagctttgcaaatattacaactgtgaattcgatgacagaggcaatatcggaaagcgttacagaagacaggatgagatcggtacgccgttctgcatcacctatgactttgattccgagacagacggagccgttacggtaagagatcgtgacacaatggagcaggtgagagttccgattacagagcttaaggcatattttgaggacaaattcagattttaaaatagttactgtttacatcccgccgttttttgggcgggatgtgagcaataacacactactgacatatgacaacacagggccgggatcatcgatgattgattccggccctgtttgaatgaaagacggtggcctgtgcgcaaagcgcgcctttcaccgctttggaggaagcttgatggcgaagcgaatctgcccgggatgcaggaaaatatatcctcaggatacaagcgtatgcccgcagtgtaaaaaacggctggccgatattgaatatgactttgagctggccctttccatgataaaggaaccggttcttctgacaggcagcacggacacggagcttcaggccctgtatctggaagagggcctgaggcgaaaaaatatccctttctatgtggaggaaatgaaaacagcggtgccaaccggaaattaccgggaacacacggtagatataatcccggttacaaattattaagtggataaaagcagtctggatgaggcattggccgtcctgaaaaaagtgggggaggagactgagatagataatgcacagccggtaatctatctcgatatgccggaagaggatggggaagatgaggaggacgatgtcataccggatggaagcggcggagcattccgaagagttttttgcggaatggaaccgtcagcccggtttaacgtcctgattataggacttgtagcgggatttgccgtactgggcttatttttagctctgatttctttgggataaagacgaatacagatgaaaaatttctttgcttgtctgattttctctttttcatatccctttctgtgaaatccaactaaaattagaagaaaagcgtgcttttctagtgggctaacactaaaatctgatatgcataccagcctgcggctggtcgttggcagacaacactaaaattagccacaaagagagagtatatagcacagtggtgttttatgaacgaaactatcaacatctatattgcggtcttttagcgtaatgtgaaatactgcaattattttagcgtaactgcgtgaaaagtacaagagaacaggaggcggtccgctccacagtgtttcaatgatgaaaatttacaaattatttggaaataaatgaagaaaacccctttactagaggcgagtttatgttataatattcacgatgggcggattgagcaggcgcatatccagaggcccattgcagcgtcatcttgtatgggagcagcagtggacacctggatatgcgcctgtaagagcgggacttaagcgtacatttaagcgtctattggtcacggaggaaactgtagccaataggcgtttgaatgtgcgcttgcgagagcgtaacgcggacggacaggcgagggtcttttgtccgcgggaattctcaatcctttgctcatcgcagcatatcaatgttaacacataaactttaggaggaagaaaacttatggcaaaatgggtttataagttcgaagaaggcaatgcatctatgagaaaccttcttggaggcaaaggctgcaaccttgcagagatgaccatcttaggaatgccgattccacagggctttactgtaacaacagaagcttgtacagagtactacaacagtggaaaacagatcacacaggaaattcaggatcagattttcgaagctatcacatggttagaggaactgaacggcaagaagttcggcgacactgaagatccgttattagtatctgtacgttccggcgcccgcgcatccatgccgggtatgatggataccatcctgaaccttggtttaaacgacgttgcagtagagggctttgcaaagaaaacgggaaatccaagatttgcatatgattcttacagaagatttatccagatgtattccgacgtagttatggaagttccgaagtcccatttcgagaaaatcatcgatgcgatgaaagaagaaaagggcgttcacttcgatacagacctgactgccgatgatttaaaagagctggctgagaagttcaaagctgtttacaaagaggctatgaacggcgaagagttcccacaggagccgaaggatcagttaatgggcgctgttaaagcagttttccgttcctgggacaaccctcgtgcaatcgtataccgccgtatgaacgatatccctggagactggggtactgcagttaacgttcagaccatggtatttggtaacaagggcgagaccagcggtacaggcgttgccttcacacgtaacccatccacaggtgaaaaaggcatctacggtgagtacctgatcaatgcacagggcgaggacgtagttgcaggtgtccgcacaccacagcctatcacccagttagagaacgatatgcctgactgctacaagcagttcatggatctggccatgaagctggagaaacatttccgtgacatgcaggatatggagttcacaatcgaggaaggtaaattatacttcttacagacacgtaacggcaagagaacagctccggctgctcttcagattgcctgcgatttagtagacgaaggcatgatcacggaggaagaggctgttgtaagaatcgaagcaaaatctcttgatcagttacttcacccgaccttcaacccggctgctttaaaggccggcgaagtaatcggttccgctcttccggcatctcctggcgcagcagcaggtaaagtatacttcaccgctgatgaggctaaggctgcccacgagaagggtgagagagttatccttgttcgtcttgagacatctccggaagatatcgaaggtatgcatgcagccgaaggtatcctgacagtgcgcggcggtatgacaagccatgcagccgtagttgcacgtggtatgggaacatgctgcgtatccggatgcggtgagatcaagatcaacgaagaagctaagacattcgaacttggcggacacacatttgcagagggagattacatctccttagatggttccacaggtaagatttacaagggcgacatcgagactcaggaagcttccgtaagcggaaacttcgagcgtatcatggtatgggctgacaagttcagaacattaaaggttcgtacaaatgccgacacaccggaagatacactcaatgccgttaaactgggtgcagagggcatcggtctttgccgtacagagcatatgttcttcgaggctgacagaatcatgaagatcagaaagatgatcctttccgattcagtggaagcaagagaagaggctctgaacgaattaatcccgttccagaagggcgatttcaaggctatgtacaaagctctggaaggcaggccaatgacggttcgctacctggatccgccgctgcatgagttcgttcctcatacagaagaggagcaggctgaactggctaagaacatgggccttactttagcagaagtaaaagcaaaagttgacgaattacacgagttcaacccaatgatgggccatcgtggctgccgtcttgcagttacctatccggaaattgcaaagatgcagacaagagccgttatggaagctgctatcgaagtgaaggaagagacaggaatcgatattgttcctgagatcatgattccgttagttggcgagaagaaagagcttaagttcgttaaggatgtagttgtggaagtagctgagcaggttaagaaagagaaaggttccgatatgcagtaccacatcggtaccatgatcgaaattcctcgtgcagctctcacagcagatgccatcgctgaggaagcagagttcttctccttcggtacaaacgacttaacacagatgacattcggcttctcccgtgacgacgccggcaagttcctggattcctactataaagcaaaaatttatgagtccgatccattcgcaagacttgaccagacaggcgttggccagttagtggagatggcagttaagaaaggccgtcagacacgtccggaccttaagtgcggcatctgcggcgagcacggcggagatccttcttccgtagagttctgccacaaagtaggcctgaactatgtttcctgctcaccattccgtgtgccgatcgcacgtctggcagcagcacaggcagcattaaataataaataattagcaataaataaagcgaaagccccagagttgcagctctggggctttctatatgcttagtgtctccaacggttccaggattcaatatctccatagaacacattcaaatcaataaatgtttcttccccggcatatccattcagccgtccccggttggtatactgccaaaagcaccaatctgcctgagaatccggctttgtaacaacatttcggatccataggggatattcatcgaaatggcctttcaaataagtttcccatacatcttctgtagaatagagaacgggaggtttatgataatattcctcaagccggtccagcataatctgcagctgctcccgcacagactccgggtccggcggattactttttttatcagcataatactctacatcaactgcagggggaagcattccaaaccggtttccaaccgtatgaataaaatggtccgcctgggtatcaccgctgctgtcaaagctgaaaaaatggtaggctcctgccgccaggtcggtcttaccggactcttcccagttatatgcaaacctggcatctgtatggctgctcccctctgtagcttttatgtatgcaaacattatattttgctgtgccagtaccggccagtctacttctccctgatagtgggacagatcaatgccggacacaggatactgtttttttgaagggttgtttaacagcagatatccattgtaaatgcaaaatccatatccaagaacgcctataacgaaaagcagcaggattaccggtatcgccatgatggttattcgtcttttctttccgtttctgtcgataattcgttccacacggcctcctcctgctgatgtctgtcacaatgatattggtcaaaccgggagcagtacaccagccttaaaaatcattgaattcaaataattcaaacaattctccctcaagttcaaaaacatcgcggatcggaacacgcatcccgtcttccaagataaggagctgccgatagccatcaatccgctttatgacaccggtaacggaaatataggctcccccctgctttttttcatccggctgaaagtaggtcagatggatcacaggatgttcatccagtctgctgcaaagaagtttaagcctttcatccagtattgtctttgcggtttcgtccagttccacccgttcctcggtccggcgggccgtttcctgaagcgccgcataatgaccggtcagggctgagaagggggcgaattgcgccgcccggtccgatatggacataggcggatgggatttggaaacgggatgagggaggtgaatgatatcctcataatcacggggagatttatttttgccgtccatgatcattcctttcaggagacccattatgcctgatggcctccgatttgattattgcgctgtaaggtcatagccccgtcttccaggttcatgccctttaaaactgcattttttccgtatttctttttgatggacagcatagcctgctgtatctgtttttcttttttcaacgcctctttttcttcctcctgctttttttgaagcgccgcatagtcggtgaacaggtctagctgttcgaagctttctgtctgtggaattgcattttcatcaatcacgtgattggcggaaacggtaattctccggatcagaagatttttattaataatgcggtcgtagagttccaatgctgcgtctgtgattagtctggccgaggcggtgtgccggtcaaggttggcagtgccgtgggcgtgtttggggatacgccgtccgtattggtcggtcgtaatctctcctttgtataatttgcgtatgtcagggttggtaaggttttcgatatcatatccgatggttaaaacaatctgatcggttacgagttctttatcgattaaatcaagcaccattaaatcgatcatctcccggacaatcagcctggccttttgaaaatcgtaggcatattgcagcacctggccggaacagaggcttgaggaggcgggcttgtaggatttgatatctttcatggtgcagggttcccatccccacgcatggtcaattaacagctctgcattaattccaaacaagtgatagagcagttcttcattatggtattcatttgattttccaattgagcatctggcaatgtcccccattgtatacaggccgtgtgcctccagctttttggcatacccccggccaatccgccagaaatcagtcagcgggcggtggttccagagaagtctccggtaggacatttcatccagctcggcaattcttacgccgtttttatcaggaggaatgtgtttggctacaatgtccatggcaattttacataaatataaatttgttccgatgccggcggtggccgtgattcccgtatttttcagaacatcgaggatcattttcatggccagctcccggggggtaagccggtaggtatccagatagtttgtaacatccataataacttcatcaatggaataaacgtgaatgtcttccggagccacatagttcagataaatattataaatctgtgtgctgtattttacatagagcgccatcctgggcgcggcaatgatgtaatcgatggaaagcccgggagaagccttcagttcatccgtgtaataggaagagccggtaaattgatgatttggcgcagaaatacggcgcctggcgttggcttccctgattttttgcaccacctcaaataatctgggcctgccgggtattccgtaagcttttaaggagggggagacggcaaggcagatcgttttttccgttcggcttgcatcggctacaaccaggtttgttgtcatcggatccaggtttcgttccctgcattcggcagatgcataaaaggattttaaatcaatggctatatagatacggtcttctgatggcaaaacggatggcctcctttccggttccttattttgaaacgttatttgaacttattgtaccacaaaatggggaggagaggaagacgccatgaaatcacgcaaatataaaggaaaaatacagcctttctgtttcccatgctgctgcctgtctgtctctatctcctggtcagcccggaaaaatcaacaaaagaaagcccggatctcaccggggccgtgaggccggtgaagtccgggcttttctgtttgaagacggtggcctgtacgcagaacgtgcaggctatcgttttatacgcggctgacatcggacgccgcggttaaaattttcttttttgctttccggcatttactgtagcacagacaggcggccacaatccaggagattccttcgctgtaagggacggatggaaagccgagcggtgcgacaagaattgctgccagcgtaaggcgaactcccaggccggttatgttgcagacagcgggagtaatcacgttgccggtgccctgtaggaacccaataaacagattcagcatcccgaatatgggatagaacacggagagcataaacaggaaactctgtcccagcccggcaacctcttcgcttactccgaacaggaggataaatgattttccgcccagaataacggctgctgctatggtgacggagagcaggagcatcattttcacgctgatggaatacccctcggataccctgtcatactgtctggcgcccatattctgcgccgtgaaggtggaaacagccgaggccatactgacggcaggcagcatagcgagggagtcgaggcggtatgcggaggtgatggctgtgacggcctgaacgccaagggtattcataattccctgcaggataatgctgccaaaggacataattccggattgaagaacgcagggaagtccgagcctcgtctgttccttcagcgcctcttttgtaaagctgtgacggcatgggaatttctttaccacgcgcagcagcaggtatgcaaggacgtaaatgcaggagaaaagctgtgacagtacggtggccagggcagcccccataattccccactgaaagacagctacgaaaagaatgtctacaaaaatatttgtaaaggtagcgattacgatggcctgcatggaggtcttgctgtttcccatgccgcgcaggatcgcgctgcatatattatagaccatgacaaacggtattcctgcaaaaataatggagatataggttttggtcatagcaaagatacttccgtccgtatgcatcatcgttaaaacctgttcaataatcccaaggctcagaacagccatgagcagagctgctggaacgaggtagaaaaacgaggtccgtatggcctcgccgattttttcattatccctgcggccggtcagttgggcgatatagatggagactcctgtggtaaagccgataatgacattcgtaaaaaacattacgatgctggtggaaacaccaatagcagcaacggcattttcaccgataaaattgccggctatcatggaatcggctatattgtataattgctgcagcaggctgctggctaccagaggggcagcaaactggaatagtattttagtgatatttccttttgtcatatacggctcctgatatgtaacggtattgtcagccggaggggctgatttgatctcatcatatcatacgcccttgaaaaagtcactatttttaaaggttactatttcctgactgaaatgaaaaagtaaattccactccccatttgtctggtggagtttacttctgcacagttgatatttactctttcatacatacatgctatctttatatctccttctgacagcagtagaaggagatgatttttatgagtaaatttattcctggtaaccagaagcatctcacacttgaggatcgtatttttattgagaactctttaaatcagcggcgttctttcaaggacatcgctaaatatctctgcaaggatccaactaccatttccaaagaagtgaaattgcgtagagcctccgactggtatcacaagggctccttctataatgcaaagaacttttgtgtacgaagatacaactgtcgcaaagtgaacgtctgcaataagatccttgtttgtggcatcaaatgtacttcctgccctacctgcaaccagacctgccccgattttcaaaaggaacattgctcccggctggacaaggctccctatgtctgcaatggttgtgacaagaagatttctcactgcacgattgctcacaagtatacctacaatgcgcactttgctgatcgtaagtaccaccagattctcaaggactccagaagcggcataagcattacaaagcacgaattacatcaaaaagataggatcatctccccattgattgaacagggacagtctccctatcagattgccgtaaaccatccggagctgggcatgtctgtacgcaccatttacacctacatcgataagggactattctcttccagaaacattgatttaaagcgaaaacccaagttcaaaccacgtagatgccacaagacccagattacggatcgttctgtatttacaggcagaacctatctcgattttcaagggttaggacttaattcatttgcagaaatggatacagtccactcctcacgagagtccagaaaaacgttgttaacgttctattttaccaaagagaaactatttcttgcctttctgatgaaccgctgtacaaaaggcgctgtacggcttgtctttgaccacctggagaagcgtcttggcacttataagtttctttccctatttgaatatacgttaactgaccgtggctctgaatttggggacccggacgcattagagaccggaatcaacgggttccaacgctgcagcctatactactgcgatcccatgcgcagtggccagaaaggtggtgttgaaaatgttcacactatgctgcgtatggtgcttcctaaaggaaccagttttgaattcctgacacagtgggatgtgaatcggattgtggaccatatcaattccacgccccgtgaaagtctgaatggcaaaacaccatacgaattggctttggaatcctttggcgaagatactttaaaagcacttcagcttaggcgcattgcccccgacgaggtcaatctgacacctaagctgatccgctataaccgttaactaacttacaaaaatctgctgtcggactggaagtaaacttttcacattttttgaatgtggctggtggaatttagtcttgcacacaaaactccagtggcctgttttctctgtcctaaaatatgatttttcgtaagaagttagcctaattatagcagaaacattagaaatatgcttaaaaatatctactatatatactgatttttaaatggtgatggaattcacctttgcactggaatttactttttcaagtcagcttactatttcctgctgccgcagattcggtttttttcgacaaagccgctttttcaagctctgcctgcagaaaacgccgggcggaggcaggtgacggaaaaggccggcgcttcaggccaaggatataggtaacggcctcttcccactcttccaaagagtaattgtcaggagagagcctgtccagggcatgaaaaatcttcctgaagctacgcgggtcatgtaaatcagacagataactgacaccggactccgataccagttcatttagtaaattttcgttcaagactgtgtctcctccctgctttcagtttatatggacttaaatatccgcagacctctaaagtatcaactctaaatgataggaggtacggtacatgggtttattattgccgtttcgtgagttaccacataatgatgattatgtggtataaaaaaattcgattatcggttcttctacatattaatttaacacgaagagacaaaaattacaatatattgatacctttcatttttgtcaaagcatgaaaaccagaccggaacactcagatttttttccggtctggtttttatacttattttcatttcaaatatgtcgcgggggttgtcctgcatgccagaattgcgggagtttaaccacataatcatcattatgtggtatttttatgtgcgtgtaaaaacaagtcccatccggctgagctgccgggaatgcatcagtccgctttccattgtataaatacgggtggttgatacattggaatggccaagtaaatctgcaagtcttgacaggtccttttccagcgcataatacgtgcgggcgaacaggtggcgcaggttatggggaaatactttgcctggttccacacctgcgctgtcacaaagcattttcatatccttccagatattggagcggtcaagagggcagccgtttctggtgcagaaaatgattcctgcgtcaataccacgctccctgcaataatgccggagcgcccggcacaggtcgggagggagaaagataatgcgtgtcttacccttacagtcagcctcagctcttcccgtttttgcagattccgcagtaataaatttcagttctgagactcggataccggtggaacagatagtctggagaagaagagataatctgttattctgcctgttttctgcggcttttataagcctgcggtattcttctgcggtcaactctttcttagggtttgaaaagatttggcgttgaattttaagcgctttactttcaggcccggaagttcgagccagtccagaaatctgttgacggacgccagcatggaattgacactggccggtgcatgtgtctgtgttaaatgctttttccagtccagcagcgcctctttgttcatcggctgtccgtctagaaaagtaaaaaacactttcaaatcccggatatatttcgtgattgtgtttctactgcgttcctcctggtgcagatagttttgaaattcagcaatccgtgtacaggaaaagatttcatcaggtttgttttgtccttgttccattttcatttcctcacttttttggctaatataatatggttattgtacctgaaaatgcctttgctatactttttgtaattcaggcacactatttttaccggcagaaatttgcaaataacagtagttatacagccaatggttatgatatactatgagcacttgatgaggtatcccacgaatctagtgcgagtcatatctatacactcagcgaggtatttaacgagcatagtgaataggatatactatgagcacttgatgaggtatcccacgaatctagtgcgagtcatatctatacactcagcgaggtatttaacgagcatagtgaataggatatactatgagcacctgatgaggtatcccacgatactggtgcgagtcaagttatacaaaattaaaagatgaatggattatttttaagtaaaaggagagaaaaatcatgctgcaatttcatggaagtgaagaatatatcgcgtcggacgaactgatccgcagtgtcaatatcgctgctgctttaaagaaaccgctgctgttaaagggagaaccgggaaccggaaagacgatgctggctgaagcgattgcaaagtcccttggaatggagcttttaatctggaatatcaaatctaccacaagagcgcaggacggcctctatgtatatgacacggtacagagactttatgacagccagttcggaaccgagggagtaaatgatatcggcaaatatatccgtctgggcaagctgggggaggcgtttaagcgtgaaaagcagacggttctgctgattgacgagattgacaaggccgatttggaatttccaaacgatctgctctgggagctggacaagatggaattttatattcctgagacaggggagacggtcaaggcaacggtacgcccaatcgtcatcatcacgtcaaacgcggaaaaggagctgccggatgcatttctgcgccgctgtatcttccattacattgcatttccggatgcgtctatgatggaacgtatcatcaaggctcattacccggatttggaacagaagctgattgacggcgtgctggaggcattttataaaatcagggacatccggggacttcagaagaaaccgagtacctcggaggtactggactggattcaggctttgtcaattggaggcattccggtgaaaaagcttgagagggagattccctttgccggtgtattgttaaagaagacagaggatttaaagcaggtggagcgaaaaaatgtttactgattttctttatctattgcgtgcgcagggaatgaagacaggcctgaatgaatggaacagcctgatggacgccctgtccatgaatctcaacgaggccagcctgacggaattctattatacggccagggcggtgcttgtgaaaaaggaatcggattatgacaaattcgaccaggcgtttctggaatattttgaaaacgtcacgacatatgacagactgcctcaggaagttctcgactggcttgcaaaagcgagagagcagacgccctatgacaaagatgaggtggacgcccgctttgagggccttggtctggacgaaatccggaaaatgatggaggagcgcttaaaggaacagcatgagcagcaccacggcggaacgaaatggataggaacggggggaacctccgcgttcggccattccggctatagtccgaggggaatccgtgtgggaggacctggaaagaacaggagcgcccttcaggtggctgaggaacgaaactacagggatttccgggatgattccgtcctgcagatacgccagttccagatagccttaagaaagctgcgtctgctttcctgccgtgaagacgggccgaagaccgagctgaatgtggaaaaaacgattgaaaaaacgtgtgatcaaggcggaagactggagcttgtcatggaacgtcccagaaaaaaccagacaaagcttcttcttttgatggacagcggcggatcgatgtggagctatgctgagctgtgcaaccgtctgttccaggcagtggatcagtcatcccattttaaagatttaaaggtatattattttcacaattgtttttatgattatcttttcacaacgccttcctgttcctggagggagaaggtatcgacggaatgggtgtttaataatctgaagccggagtataaggttatcctggtaggggacggggccatggcgccctcggagctgctctaccgcggcgggagcctcgactatttccaccaaaatgacaagacgggcctctactggctggagacattaaaacggagatttccgtcctccgtctggatgaacccgattaatgagaaggtgtgggactacacgtacggctaccagacgattggcctgattcgggagacaattccgatgtttcctctgacggtaagcggcctggagaatggaatcaaagctttaaaaaaaggggaataggcggggaataagcccgttaaagacgtgataaagtgacaggaggcaagacataaatggaacaggtggaaacgcttcttcggctgtccgacagcctggagaagcatacgatcgctgtccgcaggatgattcatcagaaaccggagctggcctttgaagaatataagacagcagggctggttatgcaggagcttcggcggatgggaataccatatgaggagagtccggtggagccgggaatcgtggcggtaattgacagcggcaagccggggaagcttttgatgctcagggccgatatggatgcactgccaatcgaagagacggcgcaggtgtcttttcgttccctgaataaaggcgtcatgcatgcctgcggccatgacgtccatacggcaaatctgctggctgtcggggaaattttaaacggaatgaagggattttggagcggcagggtcaagctggtattccagcctgcggaggagcgcggaggcggaggccgccagatgatagaagcagggctgatggaggaacttcccgacgcttgtatggcacttcatgtgacatccgatcagaggggaaagttctatgtgggtgtcggtccggtgacggcgttctccgaccgctgtgaaattgtggtgcatggaaaagcggcccattcctcagagccgcaggagggagttgacgccgtctatattgccgcatcgatcatcgtggccctcaacacactggtgccgaagaacttaagtcccatggagcattcaactttgaatatgggaatgatatccggcggagctgcgcttaacgtaattaccgaccgggttgaaatgcatggcatgatgcgcaacgctgaagcacagaccaggagtgttatgatggaaaagatacgttccctgtcggaagggatcgcatctgccatgggcggaagctgcgaagtgaaatttgaagaggggtatgcggcggtctataatgacaaaaccctggcgaaacgggtgattgccactattaaagagaatgaggaggcactttataaggggcttcccacaggtgagccgtatccggaaatcgtcaccggcgatcttctcagactggcttcggaggatttcggcttcttttcacagaaggtgccttcctgttatatcatgatgggtacaggcgaaggcgctccggtccacaatccggaatttaaggtggatgaaacatatataaagctggcgtcgaggacgatggccgctgttgcgattgattatctgaaggactgaaataagaaaattacatagaaaaaccgttcggacagaccaaaaccatgaaaggaaaaggcgtgttatatccggacggtttttttgcgtgcattattttcaagcttgctacagcaggtgcgtattcttaagcaggaacggaaagttctctttcagatggtaaaactccgcgagatgtgtcgcagtcagtttaacagccagctcttcatcccgggcctcgatggcgtcggcgatcatcaggtgagtgacgcttgcagtcatagcttcaacaaaacggtatgagagcattacctccatctgccgtagaaattgtgactgatatttttccagaaccggatttctggcaataatactgagctgcaggtgaaaaaggtaatcattgcgtatccgttccagacgtccggcgttctcgtctataatacaacatttctccgccagagttctgagacggtgaaaatcttcattactaccacggaagattgcaaggcgtacagccatggaatccactgcgatccgcataatccccaaattctggatcatctcgtcgtcatatgtggcgacctgtacaaaacggttgggataaattactacaagcccttcattttcaagctgttttagagcgtttcttacgggagtacggctgactcccagttcctgtgcgatggtgacctccgggatgcgatcccctggttttagttccatatttaagatcagattcaatatatggtcatatacaggttctgtcaaactggcagaagattgtgttttcatcaattctccccctctttatctttggtagtgtcaagtctgacactccgttttttattaaaaaccttgtattttcagggattacaccacttttgaaaataaaaaagcaatgacctccccttttctggtataatgagttcaccacaaaccatcacctaaaaaggataaatcattgcttatggataacattatactctatttactcactataattcaagaacaatacaaaactatctgctggctcctgaactttatctgcaaatatattccactcaagcagtgggcctttgatggttcccactcccctaaataccagaagtttactaccgaccccctcccgctcctcaagccgttcatcaaacaggactggcagtttctccttgaatactatctctggaagtacggcaaatccgtcagacccgttcagcgccgcaatggtaaatccatccctgaagataccttctgtcctctttgtggggcacctcaccactatctctacgataataatggcggcaatgggcagttccaatgcaaagtctgtgggcagacctttgtcaccggcgaggttgtcacatcgcctctccgctttgtatgcccttactgcggccactccctcgtccctaataaggaccggaagtttttccgcatccataaatgcgtcaaccccaggtgctccttctaccttcacaacctctccagggttgataaggaccatctgcatgaggattacggtaaaaacaagtataagctgcactacctctaccgggaattcacggtggatttcttccgcatggacttagactccctgcctgagaattcctcctccctgaagttttccaaacataacgctcatatcatgtccctgtgcctcaccatgcatgtgaacctccagctttccctccgtaaaacggctcaggctctgtatgacctttacggaatcaggatctcacatcagcaggtcgccaactatgccagaacggccgccattgtcattaaaccctttgttgaccactatgaatatccaaagtcctccgtctttacggcagatgagacttatatcaaagtccggggcatcaaaggctacatctggttcatcatggatgccgcttcccgctccatcctcggctaccaggtttcagacaaccgctctgtcgggccatgcatcctcgccatgcgcatggctttccggggcataaaaagactccccgagaagtttcggttcattgccgacggctatagtgcttatcctctggccgcccagcagttcgtaagggagttgggagacagcttccagtttgacattacccaggtaatcggactcacaaacaatgatgcggtctctaaggagttccgcccctacaagcagatgatcgaacggcttaaccgcacgtttaaatccacttaccgggtcagctgcggttacgacaattacaatggcgccaactataacgtggcgctctgggtcgcctactacaactttctccgtccccataagcacaaccactatcgggtgctcaatccagtcggtatgctggagggggctgacaacatgcccgggaagtggcagctcctgattctgctcggtcagcagaccatcctccagctgaaggaacagcaggctgccggttaaatctgttcttagattccgggccagaggtaaaaatgcagccatcccgaagggacctgcccttgatggcacgccaaaacaatgctatcatgctgtgacgcagacggtgaaatcttatctgttcctgagttcttcgccgtcggtaagacgttcagagcattgttttggtgtgccgtcaagggtggcggacactgccagtttctaaatatatctgtaatttacaaggttcatttacgccgggttccccggccatcggttttcataaatcacttgacactaccttatcttattttattttttaatggctaatcgaagaaatgatatatctattatatattaaaatttccattagttcaataataaaactgtatttttataaaggataacaaactttataaagtgtgcaataactttattactaaaaataaagctttatatttgttcaaaacgccaattgtaatttatattatttacctatattatattaagtataaaataactttataaagttagaaaaattaaataaaatatcaaaaggcataggataattaaggagaaggaaatatgttaaacgaaaaagaggtaaaagaattaaaacttttttcgaaaacaatccagatgtatacgatgaaaacgataggctccctgggggtaggacatgtgggcggctctttatccatagcggatttactggcagtactttatggtaaagagatgaaatttgacagtaaaaatcctgaatggcaggagagggactggttggtttgttccaaagggcatgccggtccggctatttattcagcactggctctcaaaggctattttccggaaagtgaattgatgacgcttaacaggccgggtacacaccttccaagccattgtgacaggaatcttacgacaggaattgatatgacgacaggttctctgggacagggagcatctacagcagcgggagtggcttatggaatgaaactggacggcagagagaataaggccttcctgattctgggagatggtgaaatacaggaaggccaggtatgggaaatggcgctttttgcagcccagcaaaaactttccaacctgattgcgtttgtggattacaatcatgtccagctggacggatatacggatgatatctgctcattgggagatattaaaggtaaatttgaagctttcggctggtttgcccaggatgtaaacggtcatgacgtcaatgaaattcagggtgcaatcgaaaaagcaaaatcacagaacgtccgtccgtccatgattgtattagagacggaaaagggccatggatggagtgaaatagcgggaggcattaacggccattgtcctgctgtatcgccggagcagcttaaggaagctttggctgagatgcagtctgattacgagaaaattgaggagggcttattatgataaaaacagcagataaaatttgtccggaatcagtggaaatgaggaaggcattttgtgaaagcctgatagaattggccggagaggatgagaacgttatagttatggatggggatctgatgggagccatgggaacgaagccatttgccgacgaatacccggatcagactcttgactgtggaatccaggaggcaaatgcggttggagtagcggccggtatgtctgcggtaggaaaaattccatttgtccactcattcggaccatttatcagccggagagcatgcgatcaagtatttatgtccggagcttacgcaaggttgaacgttaaactggtcggttcggacccaggcataacggctcagatcaacggaggcactcatatgccgtttgaagatatgggaatcatgagaggaattccacagatgaccattgtggagccgactgatatcacgatgctccgttccgttatgcggcagatgaaggaaaattacggaatgttctatatgcgtctggtacggaaaacctgtatgaagatatatgaggaaggttcagagtttgagatagggaaagccgttgtcttgagagatggaagagacgcgtcggtaatagccagcgggtactgcgttgcacaggcactcaaagctgcggaggaattggagagagagggggtttacatacgtgttatagatatgtttacctggaagccggtagatgaagagacaattgtaaaagctgcaaaggagacaggagctatcgtcacagctgagaaccataatgtgataaatggactgggttcagcagtggctgagacagtggtaaagcacagtcctgtgcctatggagatgataggcgtacaggatcaattcggcgaagtgggaaatttagattatctggcccgccgttttgggctgaaggctgaaaatattatagaggcagttaaaaaagcaataaagagaaaatagcagtgcagagaaaaagagtaaaaacgtaaaagaaaaagaaggaggaaaatcatgaaagcgcttgtcaaatacgagcttggggctttgaatgtcaaagtcatggaagtggagaaaccaaaaatctcacccgatgaagttttaataaaggttatgggggcagggatttgtgggacggaccttcacatactgacagacaacagttatccggtcaaaccgcccgtcatactggggcacgaagtatccggcgtgattgaggaagtgggagagaatgtaaaaggctggaaaaaaggtgacaaagtagtaagtgagacgtattattatacttgtggaaactgctatttttgtaagacgggaagcattaatctatgtgaggaaaagctctcaattggcagcggggtaaacggagctatggcggaatttgtaaaagtaccggccaaaaatcttcactcatttccggaatcactttcttttgaagaggcatgtatgacagaaccgctggtatgctgtgtccaggccgtattccagcacggcagactgtcaccggaggattatgtggtcctgaccggcccgggaaccatagggcttctgacactccaggttatcaagctgttcggctgcaagacagttgtactgggaacgaggaaggatgaggagagacttcagaaagcgcttgagcttggggcagacaaggtcatgtatgtggaggacgaggacatcgcggcacaggtgaaaagctattgccggggaatcggtgcagatgcagtgtttgaatgctccggcgcagttcctgccattcgtcttgccatggatttgatgcggaagggggctcattatactcaggttggtataccaagcaaagacgcaccgattgatatggggaaggttgtactgagagaatatacgatagcaggtacatatgcgacaaggccaatatggtgggataaaacaatagaactcttaaatgacggaaagattgatttgaagtccctgatgagtaccgcatatcctctggatatgtgggagaaaggatttgatgaggctgtccgtggggaaggattcaaacatattattgtgccgaacagttgagcggcagacggaggggtaaaatgaaaaaaagcatcaaaatcagcagagagtttttttaatgcggaccgcggtgttaattcttttgtactcgtttgtaccactgcgatttccgtgtacagcggtttgtcctattatggatatccgtccggagtatatagcggtggaattggttatcttgcagcggcaggctgcgcagtaagcggacttttattctgcctgattggttacaggatttggattctcggaaaagaatatggtttccagacaccgtcagattatctgagagagcggtattattcggaaggattcggcctttttgtggcaattctgctggtattcttcagcattccttatatcgcagtacagttaatcacaatcggcgaaggtatttcagtaacgacaaacggcgtatttccttatcttccggccgtgcttttaggaacggtctgcgtatccttacatatcatcggaggcggtatgaaatctgtggcatggctggatacatttcacaccatcctgggagtctgcgccgtatatattgtcgtgatctatcttgtgacaaaatatttcccaaacggaggacttgtagaagcggccacagctgtggcaagcaatcctgagacggctaaaacactgagtacacccggaccaagcggagtctatacatggaagggaattctgaatatggctctgaccggcgcagtggctacgattgtatggccccacgtttttatgagatgctatatagctaagagtactaagaatttccgcgtaatgtcatgggctctgcctctggctcatctggtactgacatttggacttgtcattgtcggttccatcctggcgcctgcaattttaggatcaaactttccggagcctgacaaagtaatgcctatgctggcaaatcagtattgtacgccgttaattgcttttgtatcgattctctgtctgtttgcgtttgcggtatcaactgcagattctatgcttttgtcggccagcgcaatggcatccagagacatctatatccggcatttttatgaaaaaaagggcagaagtgtagactccagaaaggtggtttattttggccgggtcgtgttggtagtggagatgattgcctgtattgttatcacagtgacaaaatcagcatctatcattgactatgcctataaattatcctctccattctttgcaatgattctcccgtgtactatcgtaggcctcttttggaaaaagggaacaaaagagggcgctatagcaggaaccgtcagcggagttattattacaactatttttacattctttgtgatgccgccgtttggtttctcagcgcttctctggggacttgcgacaaacatcgtattttatgttggtgtcagccttgtgactacggtgccggctgaaatatctgaaaagtatattacacgtgttgaacgcattataagcggcagcacggagatatttgaaattacgaatgcagcggttgctgaagcaaaacaggcataaaatatgcaggggaaagggactcgtatatgaacagtgtatttcaggcttatgggattcgagtgaaatatccggagcggttcaggatttatataaatcaaaggcagcagtttaataacagaaacgggatggtaaagttcgacgatacggtcggtccccaggacggccggatttcacttactgtttcctgggaagaggccaaagaacagaccgaatttggtaaacagtatctggaacatgccgaagaacattattccaaaaaagtgaaaaaccgttacaggatattggataaggaactgctcacaaaggatggtcatgaaattgcattcctgcatacattgctcctgtcacagacccatatttttaaggcgataggaaaaaacatccagcttgaaattatgcagacagcccgttattgtgatgagacaaatcgaattattattgcaacggttatggcggaacgcagttattttaagggacatgagtccggcctaaaacaaatgcttctgtcggttaagtgccatgcggattccggcttaaatgagccggatctgcttgaggaaagtgagtgatatgatgaaacagctgatgataaaaccggcaatttacaaatacgaaaaagccggagactttgctgaggaatttgccctgggaaagggtgatctggtcattacaaatgaatatatttatgaaccgtatttcggagggctgaatcttggctgcgacgtcctgttccaggaaaaatacggggcgggggagccgtcggatgatatggcggaggctatgtaccgcgatatgaagggaagctacagaaggatcattgcaatcggcggcggcacggtgattgatatatcaaagctgtttgccctgaagaatgtctcgccggtggaagacttgtacgatggaagactggagattgtaaaggacaaggaacttgtcctggtgccaacgacctgtgggacgggaagcgaagttaccaatattgcaatcctggcgctgaataaaaaagggacaaagaaggggttggcagtggatgagatgtatgcagacagcgcggttttgatccctgaacttttaggaggccttccattcaaattttttgccgccagttccatcgatgcgctgatccatgcggttgaatccagcctgtccccaaagggaaatgagatgacgcggctgttcggctataaggcaattgaaatgatattgaatggttacaaaatcattgctgagaagggagaagaggccagaatcccgctgctaagtgatttcctgacagccagtaattacgcgggcatcgctttcgggaatgcaggctgcgccgctgtccatgccctgagctatcctctcggagccaaatatcacgtggcccacggcgagtccaattatgccatgtttacaggggttatgaaacaatacatggaaattaagagcgacggggagattgacaggctgaaccagtatattgccgcgattctgggctgcgggaccgccgaggtttatgataagctggaagagcttttaaatcatctactccccaaaaaggcactgcgtgaatacggtgtaacggtggaagatctggaggcgtttaccggctcggttcttgaaaaccagggcaggctcctggccaataactttgtaccgctcgatagaaaacatatttttaacatatataatgaattgtattaaagcattaaaatacgcccgtgggggactttgccggttccagacgggcgtgttttgatgctctttaaggattgtgaaggtgcatttcttcctgtataatagtagacaggatctgaataattaagcattggcaaaagaggtggaacgtgaaaaaaacagacacatcggagatgttttcaagtgtggaggaggcgaatgaatggctggatgcaattatcgagcattcctttgacggtatctacataacagacggcaatgcaaatacaataaaagcaaacagggcgtatgagacgatcacggggcttaagaagtcagaggtgctcggctgcaatatggaggagctggtagaaaaagggattgtttctgcaagcggttccctgatcgctatccgggaaaaaaggcccgtcacaatccggcaggaatttaagacagggaagaaagcgctgatcaccagttctccgatttataatgagaagggcgagattgtcatggtagtgaccaacgtccgggatttgacggagttatacagcctgagagaagaagtcgagaagacgaagctggagggaatgcgtctgaaaagggagctgagccatatgtatgaacggttcagcatcggagatcagattgttgcggtggaccgcagttccctgcaggcctttgtcatggcggataaggtagcgccccttgatacgacggtcatgcttctgggtgagacgggagtgggaaaggaagtatttgccaagtacatctattccggcagccgcagaaaggaagagagttttatcaaagtaaactgcggcgcaattccggaaagcctgattgagagcgagcttttcggatatgaaaaaggggcctttaccggtgcggaccggaatggtaaaatagggctctttgaggcggccaacaacggaacgatctttctggatgagatcggcgagcttccgatgaagatgcaggtaaagctgctgagggtccttcaggagaaggagatagagaggatcgggagttcaaagcctgtgaaggtgaatgtcagggtgatcgccgctacgaaccggaatcttgaagatatggtggaaaagaagctgttccgcgaggatctgtattaccgcctcatggtatttcccattacgataccgccgcttcgtgagaggcgggaggatatcgtcccgctggcctccagattcctggaagaattgaatggaaaatacggttttcaccggcacttctcccgagaggcataccagcttttgaatgattaccactggcccggcaatatcagggaactgagaaatatcgttgagagggccgtgattatcagcagcggagatgaaatcatgcctgacagccttcccgtattcccggccggggaccgcccctgcggggaaaaaagagagaagcaggtaatgctcgggcaggtggaggacttgaaggaggcaatgggggagctggagcttcggtatattaaccacgcatatgaaaaatacggcaatgtcagagacgccgccgaaagcctgggaatgacgccatccacctttgtacgcaagagaaaaaggtatgcaaaataaagtaaagaatataaaatatagaacatggaaagtaacagttcatgctgtctgaactgttaccacggaaacaggaggataagagtatggaacactatctgggaaaagagatcccgaaacttggctttggactgatgaggcttccgaaaaacggagaggaaatcgatgtggaacagacaaaggagatggttgatctgtttctggaggccggatttaactacttcgatacgtcctggggatacataggttcagaagccgctgcaagagaggccctggtgaagcgccatccccgtgaaagctatcttctggcgacaaaatgtcccgcctgggcggcaaagacaaaggaaaaggcgcagagtatgctggataaatcgctggagcgtacaggagccggatattttgacttttacctgcttcacaatctgggcgagtcgagaagccattattttgatgattacggtatttgggaattccttgcaaagaagaaggaagagggggtaatccgtcatctcggcttttctttccacgacaaggcggaggaactggataaaatattgacggcccatccggagatggaatttgtacagctccagattaactatgcagactgggaggatccgcacgtagaatccggaaaatgttatgaagtggcgagaaagcacggaaaaccggttattatcatggaaccggttaaaggcgggacgcttgccgtccttccggaggaggcggaaaacattttcagaaaagcagatccggagcagtcaccttcttcttgggccatccgctacgcagcttccctggacggagtgataaccgttctgtcgggcatgtcaaatacggagcagatgcgggataatatttcctttatgaaggattttaaaccgctgacacaaaaggagcggaaagtgattgaggaggtcagaaaagttctggaatcctatccgacggttccctgcaccgcatgtggttattgtatggagggatgcccggaatccgtagctatttacggaacattccaggccgttaatatatttaaacggtaccaggatctgaacggagccaaaggaaagtataaatggaatacggagggacatggatggggcaaggcgtccgcctgcatcggctgcggagcctgtgaagccgtctgtccgcagcatatttccatcagggaggagcttaaaaaagctgcggaaattcttgaataattagaggttgggggtatttaagcaggtgaggacgctgccggtgccgcgaaaaccttcgcctgagtcttcagtcccctgcacaattgattctggccggattccccgtttccgacgcgtcccaccttcaacatataaaaaacctcttgacttggagttaacttcaaggtgtattctgataaagacatacgaagcagaataccaaaggaggtttcaacatggtatataaagagtttcaggataagaaattatcctcactggggttcggtgcaatgcgtctccctgtgtcggacagcatcccgggtacccccatcgatgaagagaaaacggaagagatggtggattttgccctccgtcacggcgttaattatttcgatacggcctatggctatcatgacgggacatcagaagttgtaatgggaaaagtactcggtaagtacccgagggacagctattatctggctacaaaatttccgggatatgatttatccaatatggataaggtggatacgattttcgaagaacagctgggcaaatgcggcatggaatatttcgacttctatctgctccataatatatatgagaagaatatcgatccgtatctggatccgaagtacggaatcatggactatctgttaaagcaaaaggagaacggacgcatcaggcatctcggattttccgctcatgggcggtatgatacgatgaaacgttttctggaggcctatggagataagatggagttctgccagatccagttaaattatctggactggaaattgcaggatgcaaaagcaaaggtggagcttttgaacgaataccacatcccgatttgggtcatggagccgctgcggggcggcaagctggctgagctttccgccgaaaatgaggcaaagctccatgctctgaggccggaggaggcagtgccagcctgggcgttccgtttcttacagtccataccgggcgtgacaatggttctctccggcatgtcaaacagagaccagcttgagaaaaatatcgccacctttgcagaggacaggccgctgaatgaggaagagatggctgccatacttgaggctgccgacagtatgctggatgtgcttccctgtaccgcctgccgctactgcgtgtcccattgcccgaaggggctggatgttccaaccctgctttccctttacaatgagacacgttttgtaaacggcctgattacccatatggcggtggacgctcttgatgaagaaaagcggccggatgcgtgcgcgggctgtcacagctgtgaagccgtctgtccgcagcagcttgagatcgcaggagcgatgaaagactttgtcagaaagcttgcgcagccggccggattataacgtttcagaccgctgacgtttaagcctgccaagactgcttaagcctgccaagcctgcgcgtttaagaccgccggccgggaaaacgctcctcgaatacttttctcagcccgtccctgaaatcgggatgggcaatttcaatgagagccagggcgcgctgtctcaaggtacgtccctttaatttggcgattccgtattccgtaaccgcgtaatcgatatcgtttcgcgaggtggtgacggcggctccctcatccagcaggggaacaatctttgatatttttccctttgcggcggtggaggggaaggccaggatggaacggccatttgccgccatggcggcaccacggacgaaatccacctggccgccgactccgctgatttgggtgaggcccacggattccgatgcggcctggcccatcagatcgatctggacgcaggaattgacggagacaatattgtcctccttcatgacttcgaccggattattgacatagtccaccggaagcatcgccacatccgggtttccatctacgaaatcatagagtttccttgttcccatcagaaagctggctacgtattttccgggattcgtcttttttaaacggtttgtgatgactccggcttcggccagctccacgactccgtcggagaacatctctgagtggattcccaaatcttttttgtcacccagaaagcggagcactgcgtccgggatagccccgatgccaagctgcagcgtatcgccgtccctgatcaggccggcacagttggccccgatagccagttccacatccccaatcaccgggggctccagcgtaagaagcggtgcgtcatgttcgacaacagccgtcacgtcggagatatggattgtgcctccgaaggtgacaggcatctgtggatttacctggacaatcacggtttttgcggatttcgcagcctgcagcgtataatctacggagatgccgaggctgaggttaccgttctcatcgggaggagccgtctggattaatgctgcgtccacggggaggctgccgttttttaaaagttttggaatttcagagaaaaagcagggggtgaagtcacctcttccttctgcaacggcttttctggtcgaaccgcccacgaacagcgaattgtgccggaaatgcttttccatgccgggggcgcagtatccggcttttcccatcgccaccatatgaacgatctcaacattctcatactgttctgctttttcggttaaaacatccaggaggtaggacggttctgcgcaggcgtggcctacaacgacccggtctccggagcggatcagattaagcgcctgatccgcgtccatctttttgctctgatagagttctttaaaggacatggtaattccctcctccatttaactttctttaattccggcgatatcctttgccagctttttcttcatgccgatattgccctggcgtgcaatcataatgcgctgggcctgcggggagccggcgccgtgcatggactcagtccggtagccgacggcagcggagccgagtgtcaggttttcaaccaggcgcatcatccgcatcctgtcctcggtcggtacatcattcacgccccggaaatatttgtctatgtagcggcccagcttcggatcacgcagatccttctcggagggagccgtaaccatcagtcctccggcaatatcctcggccagtctggcaatctcataggggaacctggttacattctgtttacagacattggccagcagcagatcaattaaatagttgcctgattttgtctgcgcgccttctgctgagcaggcgatgccgcagcagtacagcgtctcgtttaaatgggtcatttcaatcagtttgtctttgacatgggaggctctggcagctccgttataatcggctgccgcagcggcagctccaattaagacgtcgccgacgcctaccttgcatccgccgtaagactgtctgtgatatccggcaaaccgctccacgaggacgccggcgaattctgtttcgccgtcgaggaaaattcggtcgttcggaataaatacattatcaaatattacgagcgcttccatgccgccaaaccggctgttgcccacatcaatatcggagccctccagctttctcgtatcgcaggactgacggcccacgatcataaaaatgccttctgcatcggtgggacatgcgaaggaaaccgcataatccctgtcttcaggtcccatggactgggtaggcatgacaatcacctcatgggaattgacaaagcctgtctgatgagcctttgcgccgcggaccacgataccgtcgggacgtctctccactacatggaggaacaaatcaggatccttctgcgcatgcggggccagggaacggtcacctttcgggtctgtcatggcgccgtccacagtcaaatccttctcctgtgtatactggaggaactttttgaagttttcgaaataatgggtgccatacttttcatcaatttcataagaggtgctgtaaacggcgttgaaagcgtccattccgacacagcgctggaagcaggccgctgtcttctgaccgcagagccgctgcatttttactttcttgacgagatcctgggcgttcatgtggatgttggtaaagcggttgattttttctcccgtcaggttggaggtactcgtcatcaaatcctcatattccggcatctgtgccaaatcataggtcatttttacggaattaagagacggacgcaagatcgggtcgtcgaccgggttttcaattttttccccaaacatataaacctgaaggttcagcttcctcatactttctacatactgttctcctgtcattaaagccataatgattcttcctttcctgataagtaatgtgttagtgtttgattgaaggcggtgacctgtgcgcggagcgtgcaggttatcgtttctgccaatattaagagcaattatcgtgccagaaaaatacatagtaaatgaaatttagaaaaaaggcaggccagtcgtaacagttcccttaagacgtaacagtttggacggaaggaacagttcccataagatagcttacggcggctgaaccgttgttgcaggaatgcaacaacagaccttctgtttcatttttgcaacaccaaatttgcaacaaaggattagggatagaacgctgaaaccgtaaaagggaggaatttagttacagctcatgctgtctgaactgttacgaaatttctggcatgataattgcttactataatattcgtatccggttcatatcaggacgaagaaaacaggaggcagttgatatggcagaaatgattgaaagaatagagaaagtgcttgaacaggatgtccgtccatccctgctgtcccacgagggcaacgttcagattgtatcatatgaggaaaaaagtaagatactgcgggtccggctgacggggcaatgttccggatgtccttcggcacagcttacaacggaagaggtaattgaaaaggcggtgaaggaaaagatccccgaagtggagcaggtgctgctggtacatgaagtgagcagcgagcttctcgatatggcgagaaaaatcctgagccgcagcgggggcagtgatgacagggctgccggtaaaaagagtgccggacgggacggcgcaccgttcatacggtgacaggaggcagtatggtgattggtataaaatactgcggcggctgtaatccgggatacgtgagagaggagcttgtaaaaaagctgaaagagcgttttccgcatcatatctatgtgactgcgtcagaacggacggagtgcgatatctggctgctggtttgcggctgttcctcggcctgtgtttcaggcgaaggcctgagcgccctgagaaaacggttcgtgctgacaagcatgaaggagttttcgaaggcggaggattacctgaagacagagagcgggcagcagatgaaacaggggaaagaaaaagagaaagcagaaacggccggagtcgaagcaggaacggtcagatatcttaggattggtgaacgtgcatcggctgtaaagacattttacaaagaggatgcggacaaatttgcgctgctgacgggggataataaccgccttcatacggatcgggagttttccgaacggcagtggtttggacggccggtagttcatggcgtcctgacggccagcctgctgtccacggtgatgggaacgaagatgccgggaaacggtacaatcctgatgagtgaaaatctggagtttgtgaatccggtatattttggggatacggttgaagccgtagtgacttttgtctcctgccgggagacaaagttattttatgtcggagaattttacggagagtgcagaaaccagagaggagagacggttgtaaccggaacggtaaggcagatgatgatgaaatcgctcttttgtttaaccggcggtataaaacaggaggaataaaaaatgacgaatctagaaaaatacaataaaattttcatgggtgtattcagaaaaaaagaggaggaactaaaggaattaaaatacagaggttttgacctctgggattcaatcggccatatggatctggtagcggagctggaggaagcttttgaaatcaggctggacacttcggatatgctgaatctgacatcatacgaaaaaggcaaagaggtactctccggatacggcgttttgtttgaggacggccgggaaacgggaagcgtatgaaatatcaggcaatactcggcatgcctccttttggggtgccacagtctgaaaaagagcggctgcttttaccgtatctcagtcttctgacggagaaacacagggaatgctgtccggaatacggccgggttttaaaaatattaggctacagccgggagaaggcaggaaaaatcgaaaagctggaacagattccgatgatccctgtctcccttttcaaaggaggaggtcttaaaagcgttccggctctggagatattcaagacagtccaatcctcgggtacaacaggacagaagcgttccgagattgtcctggaccggaatacggcggcggatcagcagaaaacactttccgcggttgccggcgattttatcggcagggggaggtttccgcttcttattgtcgattcccctgaagtcctgaagaacagggagcttttttccgccaggggagcagggattttaggattttccattttcggcaccgagcgtttctacgctttaaacagtgatatgagcctgaatctggacggaatacaggaatttcttgagcgccatcggggagaaccggttcttcttttcggttttacctttatgatatggaagtatttttaccaggctttgtatcggggaaaaatgaggctcgagattgaaaacggctgcctgatccatgggggaggctggaaaaaactaaaaaatgaagctgtgacggaacaggaatttaaggaagcgctaaaacggcagactggaatcggcagagtacataattattacggtatggcggaacagaccggcagcatctatatggaatgtgaatgcgggcatctgcatgccgccagttattcggaggtaatcatgcgcagaagcctggatttttcagtctgtgatatcggggaaaaggggttattacaggtaatttccccggctgcccagtcttatccggggcattccctgctgacggaggatgagggaattatccttgggattgatgattgtccctgtaagagaaaaggaaaatactttaaagtgaccggacgggcagacggagcagaaatcagggggtgcagcgatacatatgaaaattgacggcaaaagcgggacgcggacggaaattccattttccgaaccggtgatggattttctttctgctctttcagagcggattaaaagcgatgacttactcagaagtgatgaggaaatacgtgcttttggattctggtgccggagggcaaatcttgaacggtacaggaatcagtatacagggaatgacttccggctggggagaggtcttgtctttcacatcgctccgtctaatattccggcgatgttcgcctggtccatggcgattggcctgctggccggtaattccaacatcatccgtatttcatccagaacagccggacagggaatgcgtctgaaagaactgatcggtcagatgctttcggaagaaaagaaaagcagcttggccgggctttcccaggggggaatttatgacatggtccgctttgtatcctacggcagcagcagccgggaacagacggcgtattattcctctctctgcgatgtgagggtgatctggggcggtgacaggactgtggacgaggtgcggcagattccgcttcgcgcggatgcttatgatatcatctttccggaccgcagttccctgcttcttctcaacacggaccgggtatcggaattggaagaggacgaactgcaggctctggcacaccgtttttatatggatacttacagtgtggatcaaaacgcctgctccagcccgtcctccgtgatctggcatgatgagggcggacaatgggcggaaaaggaaggggtcaggaagcgctggtgggcagccgtggaacaggcagccgcagcataccaacttacaccgtccagggcataccggaagtttcaggcgctctgtgaagccgctcttaatgatacttcgctctgcgaagcggtccggtacggcaaccggctctgggtggtgccggtacaaaagacaaaggagctggcaaaacggaagggcagctttggaaccttttatgaatacgggataaaagaactggaggaattaataccggccgtaaataaaaagattcagactatgacctgctatgggtacgacatacaaaaactgcggcgctttgtgagagattcaaggcttaggggcatagaccggattgtccctctggggcaggccatgacctttgaaccgacatgggacggaatggatctgatcgaacggctgtcaagagaaatatcgtagttacatttcgtaaggagatgagaagatgctcggcacattttatgaagaaaggccggaactaaaagaaaggacaatgctcctggacgataggggagccattgccacatacggggatctcgatgagttcagccgaaggacggcggggaggatgaaaagccggagcctcctgtttattttatgcgggaacagcatcggctcagtttttacctgctttgcggccctgagaaaccgcgttgtgcccctgcttctgaaccgccaaatcatggacgacaaggccaggagggagatgctcggtgagctgatggaagaatacaggcccaaatacctggcgctgccggaagaagtatatagcgccaatccggattatttcgccggcatgccgcccgtctggcacgaatggggctatatctgcctgagctgccggccgtgttcggagagcagccgggaggtaaagctttatgaagagctggccctcctgctgacgacatcgggaagcaccggaagtccgaagcttgtcaggctcagctataaaaacctgagttcgaatgcggcttccatcgccagctatctggagcttacccggtcggaacgccccgtcacaacgcttccgatgaattatacatacggcctgtccgtcatcaacagccatgcgctggcgggggccgccgtgcttttaacggaaaagacagtgtttgaccgggaattctgggagtttgcgtcggcagaaaaggccacttcccttgcaggtgttccctatacatatgagatgcttaaaaaattaaagtttatggagatggaactgccgaatctgaaaacaatgacacaggcgggaggaaagctttccgtatcccttcaccgtgaatttgccgaatatgcagccggacatgggaaacgttttattgtcatgtacgggcagacggaggccactgcaaggatgggctaccttccggccggcgaagctctgaaccggtgcgggagtatgggaatcgcaatccccggagggaaattccgcctgacaggggaggacggcagagagataaaagaggcgggaacgaccggcgaacttgtctatgaaggaaagaatgttatgctgggctatgcaaaaaaccggagcgacttgtcaaagggagatgaatgcagagggattcttttcaccggagacatggcaagacgtgatgaggcaggtttttattatatagaagggaggaaaaaaaggtttctcaagctgttcgggaaccggatcagcctggacggaaccgagcgccttttgaaacatcattttgggggctgtgattttgcctgtaccggcaatgatgaagggatgaaaattttcatggctatgccgaaggagagtatgggttcgccggggcattgtgcattgccaaagccggaggagacggcgatctttctggagaaggcgacaaagctgagccgccgtgtatttgaggttatcacagtcggggaaataccgaaaaatgatgccggaaaagtgctttataaaaagctggaagaactcccgtaaatcatgtatgatgaatacataataatgggaaaggatttgaaggaatgaattacgaagaacagctgaaacagacgaatgagacaaatcactttatgattcacaacaatattaaagctgcaatgcttacaaaggatcaggcccgtgtcaccgcagccgtcacccccgtctcgctgaatgcgatggagagcgttcacggaggccttatgttcattatggcggagatagccgccggcctgttgacgagaaacgacggccgccgccatgtaacggtgaacagttccttccggttcctgaaggggacgaaccgggctgaggaactgactgcggaggcggccgtgataaacaggggcaggagactctgcgtctgccgttccgttgtcagggagacgggcaatgagagaatactggcggagggggaatttacattttactgtttggacgagggatagatactgtctgaagacagcttttccaccgctctttttaatctcccgcacccctccacaatattttcatagctgtttgcgaaggacatgcgaagataaccttcgccctccggaccaaagacatcaccggggacaaatgcgagctttgcctcatttaacagatattctgccacctcagcggacggccttcccagcttttttatgttgataaagatataaaaggcacctttggggcagaggcagcttatgcccttaatccggttaatggcacccacggcataatcgcggcgtctctgatattcgcggaccatcccgtttacagctgggcaaagatgggattctggtaaatgtcatagggccgggaagaatcggcacagccaggattgatcagatggatcaggtccgcgcagagaaggcgggtaaaacagtggaggagatacggcagtcggcatttgcgagtatcccgctgggccgctatgggaagccggaagagtacggcaaactggctgcctttttgctggcgccttccaacacttatattacgggacagaccgttctggtggatggtgggatggttaaggcgttctgacgcttatccctccgggtgaagcatcatatatttgatgaaatcgtctgacagcggtgacggtgcaggatgctttttataagagatcaggatttcacgggatgccatctcgtcccccaatttataataggccagtttatcacttgcttcagtagctttaagcagagtatttctgaaaaaagtgataccctggccgttttttgctatattgtaagcagtcagcatctgatccagatacaggcaggcatttggctcaaagcctgcccggcggcagagctccatagccctcctgtacagatcatgctgctttttcagcagcaggaaaggctcttccttcaggagcgaaagatcgacggcgggaatctcttcactgaggaaactgagatccttaatctgggagccggtgaggcggtaagcggccaggcgctcatttacatcaaaatgggaaggcacggccaggaggatatattcccgtccgagaggaatggattcaaatacctggctgtccatggtctccacatccataaccagatcaagctcccccgactttagcttttcttccatgtccgtgacaacggtttctatcaggttgagcgtacagccgggattgtgttcgtgataccgttttataatgccgggaaggacgtaggtgcagaagtaggaggagcttccgatattaagcgtgcctcccctgactccggcggcagaggcaaagtatgcatcaatccgctcctcgatttcagcaatttccaggccggcttttatgtagaattcgcccgcaggggtgagagtaaccgggttaacgccgcggttaaaaagcggtacgccgtaaagctctgtctcgacttttttgatagcggcgctcaaagccggctgcgagatatagagttttgcggccgcctttgaaaagctgccctcctggaagacggtatagacatattcgaagctgcggtttttcatgatttaatcctcctgcttgtcaacggaacctgacattattataatttgccgggagataaaatgcaatcaggtatgtcaggatccgcctttgaccgcctttctggcctctgccagggacttgacctgccgcatcatttccgtctggattatcgtttctgttgccgtaaatccgtgatataattataaaaggataaaaggtgttaccggaacagccataaaaggaaattttatagagttttttcgtctgacgcaggatgacggaaagaagacgggagggaaaagtgttagaaataaggacggcaaaagaggaagagtttgagaaagtagtgtcattttatgacgcggtgattgatgggatgcagaatgccgaatcaaagccgggctggaaaaagggaatctatccggatgagaaatttttaaagggagccattgaacggcaggaactgctgatcggcattttggacggtgtgattaccggagcaatggtggctaatcatgagtgtgccgatgggtatgagacgatagaatggaaaaccggtgcaggtccacaagaggtaactgtcatccatgcgctcggagtcctgccggaacaccagggaaaagggctggccggagagatggtaaatgaggtgataagacgggcctgcattggcaggcagaaggcgatccgcctggatgtgcttgcggctaacgtatcggcccaaaggttctatttgtccaggggatttgagtactgcggcaccgtaaaattattttatgaggatacgggattgacggaatttctgctgtatgaatacatactgtgattcaaaagcttttattaccctgtcaccgctttctccggcccggctgctcccataccaggatgataagacagccggcggcgtaacacaggatatctttgacatcaaaggtggaaccgagaatgatcattgcagcccggttatgctccagcccaagcagcctgccgatatggaaatattgaagaatttcaacgcagacggcaaagagcagcacataccagacaaggtttttaaccccgtgaggaaacagagctctgagaaaggtatagattaaaatgacaacgaggacatctccggcataggggcgtataaaacgatcatgcacaaaaatcccgatgaacagctcggtgagcagaaggaagaggaacatggtgagatagcggattcggggatttgtgattttcatatgcttcatggcaaaatccttcctggtttgcaatatggctcatagtgttactattcacagccgctattttgcggggctgtgaatagtaacatcatagcggctgaatatgctttaatgtgtcattgtcaatctctcttttcatttctttaagaagcggattagtttcaaaatactgcttcccgtaagaaagattgaattcatagtcgaaatcgtctggattttggccctgattatgctgaataatggtttccgccttatccagtgccttgactaattttgcttctgccgttctgccgtcttcatattcctgccagagggaagcgatgcggctgcgggccggttcctccagaagggataacagtctgctgaccgatccggcctctgatttgtacttctcatccggatccggcagcagggcggcagaaatatcgccgtcatagattttgcccagatcatggaccagagccatcatcagaagctttttcccatccagttccggaaattcttgcgagatgattccggtaaataaagccagacgccaggaatgctcggcagtgctttccttctttcctgcggaagtccaggcagtgcgggtgatattttttaacaattctagttcttttataaattcaaggtatgattgaagtagtgtcatgaaagtaacctcctgattctttatttatcagtgtagaagattacaggagacttgtcaatttgttttataacctgcgggttttgctgtatatattttctatttgactttcgtatcttagtatgatatattacgataaaataaaaatgatcgtgaggtgtgtgtttgttaagtgtgttaattgcagaaaaggcagcaaaatagttgcataaagagtagggttttctggctgttacgccaggagtctgcccttttatcggcgtgtctgtggccgatagaatctgcttttaccacttcatacacaaacctgaggtttaatttggaggggagcggtgcgctccttttttattttcatatggaagttgtcctgtgatataaaaatgctccgcgaggagctccggtcctgggaataagtctgtgaacgtgggggagatacggtcatggacttattttatttaacaggaaagctctcctgttaaataaaaaccgctccgcggaggatcgcactgcggcggtagggaattatgtcgccgaagcgacccgccgcaggcggagaatcccgcgagggggattttatcttataggaggaaaacaaattgaaccgaacatttgaaacattagaatttaatcatattttaaaacagttggaagagtacgcttatacagagagaagtaaggagaagatcagggctttggagccgtatctgagggaaacggacgtaaaggttgctctgcgcgagacgacagaggccagggaaatgctggacaaattcgggaatcccccgttagtgacgcttgatcaggtggaagaactgctgaatacggctcagaaggaaggatgtctgactgctgaacagcttgagtatatcggaataacgctgacggcggtagagaggctgaaagactatctgtcaaggggaaaacatctggagtccggccttccgttttatgaggcggacctctatccgatgacggatataaaagaagagctggcggcatcagtcaggaataaccaggttcaggattacgccagcaaatatttaaaggataccagggaacagattgccaggacggaagaaaagatgcggacaaaggcagaagccgtactgaaagcgaataaagatgctgtatccgaacaattcattacttccaggaacggccgcatctgcattcctgttaaaaaagattataaattcagaataccgggaaccgtaattgataaatcgtctacaggagccacactgtttgtcgaaccggtgtcagtggcgaaatacggcgaggagcttcagcttttaaagctggacgaagaaaatgaagtcaggcgcattttatatacgctgacagcgctgatagcggagcagcaggaactgttttatgaaaatatcagggtgatagaaaaactggactttatctttgccaagggaaagctgagcgctgctgtctgcggcacgctgccgaagataaacctggaacgcagaatacggatcaggaatggccgtcatccgcttttagatcccacaacctgtgtacctctggatttcgagattggccaaaagacaagaggaattattataacggggccaaacacgggaggcaagacggtagcgatcaagacagtgggactctactgcctgatggcccagtgcggtctgcatctaccctgcggggaagctgatatctgtatgaacagccagatactttgtgacattggggacggtcagaatatgactgagaacctgtccaccttttccgcccatattacgaacgctctggatattctgagacgggtgaaccgggagagcctggttgtaatggatgagctgggatcgggaaccgatccggccgaggggatgggaatcgcgattgccattttagaggagcttagaaagagcgggtgcctgtatcttgttaccacccactatccggaagtgaagcagtacggggagaatgcggagggagtctgcaacgcgagaatggcctttgacagagaaacgctgaagccaaaataccggttggagataggccgggccggtgagagctgcgctttctatattgccaagagtctcggcatgcctgcggatatgctccgcagagccagccaggctgcttatggggagaacggcagtccggatatcatggacgcccttccggaacagcttgaacgccggtctgcgccggtcatacaaaaagaaaaaatccataagaatcatcagacggaggcagacgcattccggctgggagactgtgttatggtttatcccgacaaaaagacgggaattgtctgccgtaccgcaaatgaaaagggcgtgcttcaggttcagctgcaggataagaaaatatggattaaccacaaaaggataaaacttcacgtccctgcatccgaactgtatccggaggattatgatttttccattatcttcgaaagcgtggaggagaggaaagcgaaacaccagatggagcgtaaatactgtgaaggaatggagagaactataccatccacagactgattgtggtatactatgagcacttgatgaggtattacacgaatctagtgcgagtcatacctgaacccttggtgaggtactccacgaacctagagttcatggtatactatgagcacttgatacattaaaatcacccggtcagcggccggacagaaacaggagggatagcagatgacacagcaggagctagtcctgtcggcggaattctttctgcgcattctcacagcggcagtctgtggaattgtaatcggatatgagagggaaaacagaaataaagaggcggggatccgtactcatgcaattgttgctttgggcgctgccctgatcatgattgtgtcaaaatatggattttctgatattcagaactatgatgcttccagggttgctgcgcagatcgtcagcggcatcggattcctcggcgccggaatcatattcatcaggaaccgcgctgtgagcggccttacgacggcggccggtatctgggccacggcaggggtgggaatggcggtgggttccggtatgtactatattggtattgccgttactgttctcattgtcttgatgcagttcgttctgcacaggcagtttgtgattaaaaaagaacacaggtatgaaaaactggtcattatcatgaaagaccatccgggaattgaagagcttcaggaaaaactgctcggacagaaggtggaagtagacagtctggagcttgagatgacggaaaaccaggagtacagaatggagttgggagtttttctgccgaaagagtacaacaagatggaactgaccaaaatactgatggactgtagcggcgtcacatatgtcagatgctgaccccgcaggccgcggctgatgaagccggtaaaagaataaaagtataaaagaatccccttccgtttttttcctgatggcagcctgtcagcgggaaaataacagaaggggattttgtaaatcaggatttcggtttaaatcagaatttatgaaataccggagaactggtttcttaccttctgaattttcattgcctccgcctgctctgtcgtataccagcctttggcagacatttttttgtaaatgtcatcctgcatgcaaagactgttgtttaaggcctgatcaaagctctgacgcacatcctgggtcgaagattcaatcgtaccatgaagatacagatcacatacgcctttggtggtcagaagcaggttttccattatacatctgtcatccatttttgtaaccctcctttcatcattaggttaaacgatagaaactgtcaaaaatctgctgatgcttgtcagcgatctgctgaacacaggttttcagttcctgatcctgaagattttggattgcatcctgacactgagttttaaaaaatttctcatgtcccagagcatcctcgatataatctaattcctttggactcataattatcacctccacatttagtatgtgaagattacaggaaagtatcatcacattttccttccaaatttattccaatatattgaaacgttttttgtgcgaacagcctcggatgtaaaaattcgtaagatacgtaaagataaattctcttgtggcagatgttttcggaagatataatggaaaataatgagagaaagcagggtgaaatattatgattacaataaagaatgatatcaaagagaagaaaaaacaacgcaaaaaatatttaacgccatgtgcggcagtgctgctgatatgttccctggcggcctgcgcaggaggcggggcacagaagaatgcaggaggcgatgccggggcggcaaggactgcggagacagaggcaggaacagaggaaaatgtaagtaagcaagaagcagcctctttaactggtgaagagacggccaattcggcggaatccgcaaaagaggagacgcagacaccggtgacagagagccgggcgcaggactggtccgccctccctaatccaattgtggatgtcggttcttcggaagactttgaagcggcaggactgagactttggcttccggccaataaagaatggtatagtgatcctgactacagtatgataggtgataaggctgcgcagattcaattttacgatgagattactaaatcagatgccatcgcgagggcagccaaatcggaggaaggtgatatttcgggtatttactatgtgtttgatgacagcaggaaacagagctggttcacaaaactggaggatggaacgaaggtggacatcacggtccgggtcacctcagaaaattcagatgtccatggagtccttgccacatggtcggccggtgataccagctacagtctttgggaggatgatgcctgggaacatctggatgccgtggcgaaaatggcgattgaaattataaagatgagcgatccgggaagagagacagagcaggattaaagaccgccctgttttaattgacgggggtgatttatgcgcggagcgggcccgccgtttccagcgggccgtgtccggtttacagtaaattgtccgccagcttcatccgttccaccacgggaacgtggaagggacagcggctttcacagcccctgcatccagtacagtcggcggcgttggcgctgagctgacggtaatgggcgcgcacggcggcgggcacctcccggtgcatggaggccaggtcataaagcttattcaccatggcgatgtcgattccggcgggacagggagcgcagtggccgcagtaggtgcactggcctgaggaataagcatgatgcggtgcccgggccaggacgctggcatagtccttttcttctgcggaggcgttctcataggcaacggccatgaggacatgctccggcgtatcatatccggccatcacactggcgacagcgggccgtgtaagcgcataatgaaggcactggacaggcgtgagtgccacgccgaagggggaggtgcgggcatcgaataaacgtccgccggcataccccttcatgacggtaatcccaacttcaaggtgttcgcagatgcggtaaagctcctccctttccggcgcaatgccgcccagtgtttcatcgtattcatcggcaaaatactggttgatgtcttcggttgggggaagcagatcaaaagcaggattgatgctgaacagaatcatctcaatctcaccgctcagggccgccatctttgccacagccggattgtgggtgctgaggccgatatggcggattaccccgtctttcttaagtcctctgacatagtctatgtattcccctgacataatccgctcaaactctgcggcctcatccacgaaatggatcatgcccaggtcgatatagtctgtgccgagtctggcaagtaaatcttcaaaggcggctttcaccagaggcatacagcgggtgcgcacgtactgtcctttctgccatgtggaaccgatatgtccctgtataatccatctctcccggcgtcctttcagagccgctccgatattggagcgtacattaggttcggacatccagcagtccagaatattgattccctgcgcctcgcaggtgtcgatcacttcttttatttcccgggagtcatggcgctccagccactctgccccaaggccgatctcacttacttccaatcctgtttttccaagctttctgtatcgcatacaaatctcctttatccggtgcaagtctcagacacgctaaagggcgcaaaagaccttttgaccccaacatcatattataattaaagtataaaagggaaacgccgttttgccaaggggaatcggcaaaacggcatctggttaatcaatcccggtgcattgtctgtacaatgaccggatgttttgcggcggctttcattgacttgtgaggcagggtgcctccatgccgcctgtataccggaataataaacagaaaaagggcgatggaaagaatgaaaaacaggatataggacggaagatagcttccggttctgtctgccagcattcccggtacggcgctggagaccagtccgcccagcgcataggagagctggtaatttttcagtactgtggcgtaatttcccacctggcagaaatcggaggccataatggaaagacccacagaggccagcgcaagccccataccgagaaaaagaaaggtgattccgaacagaaggcggccggactgaggcgcgaaacagcagagcagctggccgatacaaagaaacaggcaaaataacgccgctgtacgaaagctgcctgcccggtcggcaatccagccaaaggaacatttaccggctatgagcagtatgcccatcagcgacaggaaaaaggaaacagtagcggctgaatggccggcgctggtataaagcagggataaataattaaaaccggtcagtccaagcactccaatcagaaaagagccgcacaggatacggagctgttccctccggctgagccggttgtggagcagtgtgccgccgtgaatgcagtccctggagctgccggaagaaacttctgtttccgggaaatcttccacacctgctgtttcgatccctgtatgttcaggcgtgttttctctgatcagtgccacaatgggaagcgttacggccgcaacagccagagcttgcgccaggaacgcggaggaaagtccgaaattctcaatcagaaacagcagcgtcacgggacccagaacagagccgattccgctgccggaggcagcgattccaagcgccgcggcaggtttcagagggaaccactgccggatgagcagagaggcgggaatcataccgcccatcgcatagcttatgccggacagagccgatgcggcgcagtaaaggagtggtgtggatgatatgccgtagataaaaaatgagagcgaggcagacagcattgccagtgcgattccttttttcaggccgagccgtccgtaatagcggtcggcggcgaacattgccaaaagggaggttacacttttcatcgtggcgagcagggaaatctgggtattggaaaaaccgtggacttttataataaaaggcaggcagatggaaaatgcattgctgacaagcccgacacagacaaaaaccatgacggtgctgagcgcgcatatggtaaagcggtagggttgagctttcatggatattcctcctgctgccgtttgacggcataattgttattgatgacggtgatctttgcgcggagcgtgcaggttatcgtttcatccgcctgccattactgccattatcatattagagaaatatatatttgtaaaatgaattatacaggtatataatatagacaaaatcgatatttatcatcgcggaggaagtatgaatcaggctgaagtggatgcatttcttgcaattgttgagtcaggctccctgaccagggccgcacagaagctgtatctgacacagtccacactgagcagccgtctcgactgcctggagaaagaactcggcgcgcctcttctaatcaggaaaaaaggaatccgcagggtggagctgaccgaggcgggaaagaagatggttcccgtggcaaagaagtggaaaaaactgtgtcaggagacaaaggagattatctggaaggaagaccggcagaccatgttcctgtcaacgatacagagtgtccagacttatcttatggggcctgtatacagggaattcctggacagggcggataactgcgacatgtgtattctggccctggattcgggtgatacatacaagttaatagaatcgggagaactggaagccggactgattgccaatcccggttattcaaggacggtggcctcgattcccctgtttcaggaaccgatgtgttttgtatgcggggcaggcagctcctacagcggtccggttcatcccgcatccctgtcggtcagaaatgaaatctatctggagtggcatcctgagtttgtcctgtggcacacctactggttcggagacgggagacggtgcagggtggagacggacaatatgcagctattagagcagctaatcgaacaggatgaatactggagcgtactgccgaaatcggccgctctcagcatggagggcaggatggatgtcagaatccttccgattgaggatggccctgaagacagagtggtgtatctcctgctgaagcataaagaagactgtccgccgtctgttcggatcctgcttcagatgcttaaggaatatctggagaagttgggaatcctttggattggggaagggaaaatctgatacggagtaatgaggtgcatatggaaatgaatacggaacgaaaaagaatattgtttgccgacgatgatccggagattcgggaggtggtccgtattcttctggagcatgaaggctttgaggttatcgaggcctccaatggaaaagaggcggtggaaaagtccggcggctctgtggatctgattatcctggatgtgatgatgccggggaagtcagggattctggcctgtctggagataaggaaaaaactgacggtacccatcctgtttcttacggcccgcacccaggattccgataaggcgctgggattttgcgcagggggagatgattacctggcaaaaccattttcctatacggagctggttgcgagagtcaaggcaatgctgcgcagatattacgtctatcagggaggcggaaaccggaaagaagatgacgcacagatacaaatccgggatctgcttcttaataaggacagccgtgaggtgcgtctggagggaggagaaattcttcttacggatttggaataccggattctccttcttctcgcggagaacagggggaagatttttacgatacagaatatctatgagagcgtttgggaagaaccgtattattacatttccaataacacggtgatggtacatatcaggaatctcagaaaaaaactggagaaagatccgaaaaatccgaaatacatcgtcaatgtatggggaaaggggtaccggatagagtaatgaaaaaacttcgcagcagattatggattaagctgattctgtcagccgtctttgccgccgcctgcgccgcctttgtctatgtgcgggcgctggagctgtcctaccgccttttggatcagatttatattaatccggccgttatcttaaagcgggaagagcagtatataaaggattttcaaagctatgtgacagaacagaagctttccatgaatgacagaaagaagataaaagagttcaccaaaacggattggacgattgtcatggcgctgtaccaggagaatgatataatcttcagcagtgacagccgctttattgtgcctcttccggcagatgaatacggggagacgataaaagacacatctgaggcgtcgggagtttttaatgtgacgttcacggacggcgcagtacaggcagcactggtttatacgggatatgagaattaccagtccgccggagtgattgtgacgcttttgagcggcctttgttttgccgtaattttatatcttctgattcgaaaaaaagtaaaatatattgaattgctggggaaagaactggagattttaaaaggtggagatttaaattaccagattacgataaggggaaatgatgaactggcggctctggcgggagagatggattccatgcgccgggccatccgctccagacaggaggaggaagagctggcccacctggcgaaccggggcatagtgacggccatgtcgcacgacctgagaacgccgctgacggctcttatgggttatcttgatattctttccatagaggaggaccccggcaaaaaacagaagtatctgtcggtctgccgtgacaaggcgtgccagataaagagcctgtcggataagctttttgagtattttctggtatacagcagtgaccaggatgaactgcacgcggacgaggtgaacggtgcggaatttgtgggacagatagttgaggagagcctgtttgacctggaaaatgaggggattgaggtggcgcgccgggccggagaaattacatgcaggctattggtggatgtggatctgatgcgccgggtttttggaaatcttttttccaatatcctgaaatatgcggatcggagccatgccgttcaggcggaatacggagagacaaaggatgaactggtcatccgcctgcgaaacagcgtggctgcggatgcatcggagcgggagagcagcaatatcggcctgaagacatgcgaaacgatactgaagcgtcacggaggcactttttcatatcaaaaagacgccggtatgtttgaggccgaggtcaggattccgtgcatcagggaataagcatcggatagggaaaaacattgggcagggataatctttaaatcaggaatagattcaggagaatgagatgaagatacaggaattaaaattatttaacggattgacggaggacgagcttcagcggagcctggtctgttcacagtcaaacatcgtggagtatgaaaaagatgattatatcttttctcagggggagaggcccaggtggatctacatgattctgtcaggggaggttctgctggaacagattaatatggcgggacgccagacttatgcggaatatctgggcgaaaggcagcagtttggcgttgtggacctgtttcttaagcggaaacagtattcctactcggccagagccaggagccatgtgaagctgcttaagatatcaagccattttttctatggaacgtgtgaaaataactgcatgcaccacagcaaaattctttttaacatgatgggggtgtttgccgaggaggcggagaaaaaatcaaaaaagatacagcttttgacctgcggcagcttaagacagaggatagccctttatcttctccagaacagcggtgaaaataaaaaggttgaactggtgatgaaccgggaggagctggcggccagcctgaatgcggccaggccttctctgtccagggaattatctcagatgcaggatgaggggattattaaaatggagggtcgcaaatccatcaaaatccttgattattcccggcttcaggaagacctggccgatgtttcagattaaattatcagtcttcgggaacaaaaacgtcttttccaagaccgcatatcggacataaccagtcttcaggcaagtcctcgaatgcagttcccggagcgattccattgtccggatcgccaacctccgggtcatactcatagccgcatggttcacagatatattttttcatttctaattacctccgtaatctgtttaataatacgtttgaattactcagccttccaaaggccgtgaagattgcagtactcgtaggcagcgataaattcatcgccgtcgccaagaagaaaaacggcttttggttcttcgccgggtttcagggaagcaaactgtccgccggcttttgtttcaatataaatgcccgtaatatagtgttcctccagcatgggatgagatacggaacctaccgatacttccactctgtttccgtcaaccgagacaacgggtacatgcttctcagccgcgccgtccgaggtgttggcctttagggactcaagtccgacttccttttcaccgtctaaagccaccagatttaataagatatttttcttgtcgtcacttctgtaaaatttattcatagcagacctcctgtttgttttttgatttgttatttgttctatagataagataccataaaaaatgaatgaagtccgtaacaaatgttacgaaaacaaaaaaactgtaagaaaatggaagtctggaatattcaggctggatttctgtacgcattctgctataattagtaggacatggccccaataagggaatggctacaactaaaggagaatgaacatgagacagaaaacactatcaatcgaacaaatcgtattatgcggcatgtttgccgcacttgttgccaccggcgcatttataaaaataagtatccccgtacagccttttcctatgcattttaccctgcagttcttttttgttctgctggctgcttttgtactgggcgggaaattgggaagtgccagcgtccttgcgtatctcgtaattgggctagtgggggttcccgtctttgcggcaggaggcggaccggcctatctggtgcgcccgaccttcggctttctgctggggtttgcaggcgccgcctatacgacaggaacactttctgagcgcttacaccgccatacgtttctgaatcttctggcagcggcatttgccggtatgatggtcatgtatctgtccgggatgctttacttttattttatcagcaattacgtaatcagtatgcccgtaacgtggggaatcgtgcttgtaaattgtttcctgcttacggtgggaggtgatttcctcctctgcgtgctggcttccgctctggcagtcaggctgcttccgatattacagaagatacggtaaaacttaaatttttatgacaatttcatttgttttgaaaaaacggtggaaattcggcttgtggtcgtgctatattataaacaggctgttaaacggccaaaacaaaaacagatagaggttgagagaatgagaaaaagaaaggtcttaagaactctgggagcggtgttggttctggcgctcgcattcagctttactactctggcagatgacgcgtcgcagtttgtgacggggacagatgtgaatggtattgtgataggaggacttacagaagcagaagcaaaggcgaaaatcgagcagtcctacgcttcgagctacaacctgacaattattgagaaagacggaaagaaagagaatattaacggtacggagattgggtacagggtaacggtccctgacaatctgaaagaaattctgagccagcagaataacacgggacgccagtcaggaccttcttccgataattcccatacactggagcttcaggcttcctatgacgaagcgcttctcacggcgagaatccgtggactggaatgtataaacggaggcagcatcatcacgacggcggatgcccgtatctcgccttatcaggagggacagcccttcacgattataccggaagtgcagggcaataatgtggatgcggcaaagacggaagcggtaattaaggccgcagctgcctccggacagagccaggtgaatctggtggagaacggatgctactatacggtgcaggttacaaaggacaatgaacagttaaaggcgctctgcgataagatgaaccagagtaaagacatggtaatcacatataatttcggcgagaataaggaagagctcaccggtgccgtgttcaccagctggttcaccggttccgaggacggacagattcaggttgacagaaatgccgccgcagcctacattgctgcattggcggccaagtatgacacggccggaaccgccagggtttttcatacggcgacaggcaaggatgtgacactaacaggcccgtacggctggaaactcaatcaggcaacagaggttgaggcgttaatcgcgatgatccggatgggacagagccagacatgggaacctcagtataccgcctccgccgccagcaggacggctcctgactgggggaacacctatgtggagattgatctgggcggccagcatgtctatatgattaaggacggagcgatcgtttgggatgccccgtgcgtcacgggcaatgtgtcgaagaactatacgactccggaaggaatatacagcctcacctacaagcagacggacagaatcttaagaggcgccaagcaggcggacggcacttatgagtatgagagccatgtggattactggatgccgttcaacggtggaatcggtcttcatgatgcggactggagaagcaaattcggaggcacgatatatcagtacggcggaagccacggatgtatcaacctgccgccggcgaaggcgaaaattctgtatgatctggtctatacaggcattccggtcatctgttacaattaaactgaaacggtaaagagcggggagaccttacgctgctaacgataacctgtccgctctgcgtacaggtcaccgccatcaattaaaaagatgcgggattcacttcgaaatgaatcctgcatctttttttgaggcttgtgtgagcacgcagtgcggagcaatccggtatcaaagggggcaaaagacctttagctcccaacatcttaacaggatatttctcctgtaaataaaaaccgcttcgcgggggaacgcactgcggcggtagggaataatgccgctacagcgacccgccgcaggcggagaatcccgctctcgggagtctttatcggtacagctaaagagtagagcatgttttaccggtttcggaacatgtcatttaactgttgtaaaagctcgacatcggaagaggacagctttaagttagtctcaagtgtccttccgtccgttgttttcaccgacagctctataatattgccttcggccaggccgttttgataaacggcattcaaaaacatcggaaatttcggatggttttttacaaatgtatcacaggaatttttaatcagcaaaagttccattgggttcatggcgcacctcctataataaattattatgtggcagcaaaagaaaaagaccgcagaatgaggcggtgattgaagaagctgccttcctattataataaacgcccagattcctgtcaattcggtcagaagggccggagaaacgtgactaaatcacagaatgccggtaatagacggtaatataatagcagcagacggtgaaatgcaggaaacggtgaaatgtaggaaacggcaccggacgaatgaaagagttgattcgtacaatatagagttaagttgaaaggcggatatgatgatggaaaataagaaaagacggacattgataatcgggggagtagcgggaggggccactgcggctgccagactcagaaggagggataatgacagggaaattattgtattcgaaaagggagaatacatttcctatgcaaactgtgggctgccctattatgttggaggcgttatcaaagacagaaacgcgctgcttctgatgaacccggagacaatgaaagcgcgttttgatattgatgttagaatatcaagtgaagtgactgcaatagacagagagaataagaaactggccgtttttgataaaaagtcgggggagacatatgaggaaccttacgatgaccttgtgatcgcaacaggctcttctcccgtggttcctccgatcccggggattgacggcgagggaattcatacactttggacggtgcctgatacggatcggataaagaggatagtggaggagagaaagcccgaaacggcagcggtcataggaggcggttttatcggcctggaaatggctgaaaatctgcagaaggctggcatcggcgtaagtgtaattgaaatgcagaatcaggtgatggcgccgctggattacgaactggcggaactgcttcatgaaaatatgacaatgaacggcgtggaactgattctgggggacggagtcgtttcatttgtagcccgggatgacggctccaccctaattaacctggccggaggccggacaatcagggcagagatggtactgctctccattggggtaaagccgaacagcgctttggcccgtgctgccggacttaaggtgaacgctcggggaggcattgtgacggatcggtttctgaagacttccgatgaaaacatttatgcggtaggagatgtcattgaggtcgagaattttgtcctgcaaacgcctgccatgataccgcttgcggggccggccaacagacaggccagaatctgcgccgacaatctggccggcgacaggaaagaataccatggaacaatgggaacctccgttgccaaggtatttgacaacacggcagctgttacgggagctaatgaaaaaaacctgagggcaatgggaatggtaaagaataaggattattattctgttctgatcagccagaaatcccatgcgggatattatcccggttcgacagtcctgcatatgaaaatgctgttcggcaaagacggcaggctgtttggcgcccaggctgtaggcccggacggggcggacaaacggatagacgtgatagcatcggttatgcgcagccacggaactatttatgatttagaggaactggagtccgcctatgcgccgcccttttcttcagccaaagatcctgtgaatatgcttggttttactgctgagaacattctcaccggattagtgtcattcatcagctgtgcagaacttgatgagctgtcgcccgcttcccggccggcgcaggatatgacgattctggatgtgagggaggagattgaattcctggaataccacatcccgggttccgtccacattcctctcggaaagcttcggggaagactggacgaacttgataaaaataaaatgacggccgttatctgtgccgtcggaatcagggcttataatgcagcccgcattctgatgcagaacggttttggccaggtacgggttgtggagggaggaatcaatttttataagtcacagcactttagagattttgaaaaagagcttcaggttattccggcagaaataccgggatgccctcttgacatgggaaaaggaaggagttagaaaagaaaccattatttaccggtatatcttccaaaaattttatgatattatagttttgtaacagaaatgtaataattttgaaacaactaggaggatttaccatgaagaaattacgtttactttcagctgcagctctgaccgtcatgatggttgccgcagcgccggcaatgacatcacaggctgccatgtttacgacttgtgttccgggaaacagctccggtattatatttaattcaggaatgctttcaggaggtttcggacagagaggcggaaactgccagagcggaagcaattgtcagaacggaacagactgcttcggcggaaactgtcagaacggaacagactgcttcggcggaaactgtcagaacggaacagactgtttcggcggaaactgtcagaacggaacagactgtttcggcggaaactgccagagcggcaatgactgtttcggcggaagctgccagaacggtaatacaggagccggatggcagaacggaatccagacacttccttcatttggcggaatgccggtagcatccatgcagggttcctgcagataaacaggtaacgggagaaatcctaatatatagaataaaaaacagaccgtatagtgccagtccgaaaactgccgctgtgcggtctgtttatgcgttgccgcatcacttattttccttctgcaataatgatctcctgtgcatagggaagagtcttgatccagtcacagaaagtatgccactcagccagcttgtgatcctttctcgcataataaatattgatcagcgtctcatagttgaaggagcatgttctgagctggttatagctggaaggcagaagctgaatcatatcataccagtcatctttgcttttggtttccaggtatctgaggcggatttcttccagcttgtccacaacggaatgcataaattcctgcgttgcaggtgtcatgtggtcacagctgaaatcttccggcgtaaacggtttgcttgcgattttatgcatggtgctgcaggagtttgccacggttgcaattttatatgtatcatattctttccaccagtagagcggggctgtaatgtctacagatacgaggatctgacggacatatttgcggtggtcgctgccggccatgcgaagcttttttgccagattcaaatcatttggccccaggatataacggccctgctcatcgtagaagctgtccgtgcgattccagctgttcagcgggtttctggcgccgcgaagcgcattttccatattcattacgctggttctttctaatgtaatcatggtaattcctttcattggtttcctgttttattgatactaggattattatatcagaatcgaggtaaaaatcaaatggagatttagttaagcaggtgaggacgccgccggaacggccagcggacggggtggtgggggggtgtatgagtctttcgtcccgggggaagattatcgtggtttggggctgcgggcgaagataaaggctgcggagcacgctcccgctctgtgaaatgcatcgcgctgctaagctcggcaggacctcgctaatcagcgatggatttcaacggcatccgcagcctttatcttcccctccgccccaaggccaggttttcgccgggacgaaagactccgccaagtgtatcggccccgtccactggcctgcggccgctgatagtctcacgcgttaagtgcgggggcggaccttgtcgaggccactcagtgcttccgtgtgcgggaaatacgatataccttcaatgcgcatttttatataattgcggaaggtttgatttcagtttgccggaaacacgtggtggccgcgacagagtcctccccatttaaggttggagacaatcagcggctggagcggaccatgtccggtgccgcgaaaacctccgcctgagtcttccgtccccggcgataacctgcccaggggaagtaggcggaatcaattgcggaggggacatgggagtccgccggtgcttagcgaggtcccttacgagcttagcactgatgcgcactccaaagagtgcaaacggtccccgcagcaattcattccggccggattcccccctcacgacaccctccaaccggggatggaagactcagccatacccctcgccacaccggacatggtccgttccggacgcgtcctccatcctcaatcaaaaatccattctgtccataacgcataatatttaccaagaacatgggagccgtcggtcgtatacgtttcattcagattgccgctttcatcgtcgaatattacattgacatcgatataagggcaattctcctctgcggcaatctgtttgataccctgattcagcgcattgatattttcattattgtaaatagggctccggtccgactttgttttggttacatgcaggttagcttccagaatcagggctgcttcgggctgcttttcttttatatagctaacaacggtccggtactgctttaaaatattttgattgccgtagcccagttcattgatgccgagcatcaggaagacggccttataatttttttcctccagaagctgatttaaagtcttatcacttccagcgccttttttcggtttgctgtccagtagattaaagacgctcatcccggaatctgcgaatacgtcggcatttcccaagtcgccgtattccgacaggccgaccgttctggaatctccgataaacagtacgtccgtcaaatcagggctgactgcaccaagttccttcttccagccgtccgatccgggttcgccgggagcgttgcctgaagtctttgacggctctgagggtgagggcggagactccgggggagcgggcaacggcgaagactccgggggagcgggcaacggcagagcttttagggagtcggagggacgcagagtctccggaagagttgacgaaagagcggcagatacggggaaggcaggatcccggacggcggctgatgcggcaaaatcttgtttcactgtctttccggcttccggtttcatcagaacacctccgatcattgcggcagcggcggcgatgaacaggctgaaggacaggagaatcgtataccagtatttgtgcattgctttttctccttaaaatctgaaatataaaaacgggtcatcggcgcctgcgcggatgcggtagatgcaggcccagaataaaagcagaaggatcactgcggtgatgacatcctttttgtaatgattgtagatatttcggggcagagctgttataaagacaagtccggccgtcaaagagccggaatacagcctgccgtatttcaaaaaatcaccattgaaataggtgagttgggtatttcgtgccaggaaaggaaaaagcctttggacatagactgatatatcagacagttccggtaatgcaaataccatccaggtcaatggaattgccaaagccatgtaggcatgtcctgcaagcggaaaacggtgcaggaaacgcagcagggccagcttttcaacggatatcagcacaaagaggagcaatccccaaagtagaaaattccaactggcgccatgccagaacccggttaagagccatacggaaaacagattaaagaaggtccgcgccggtttctttctgtttcctcccaacgggatatacaggtagtcccggaaccagtttccgagagttatgtgccatttccgccagaattccgtcatggacagagccatgtagggatgctcaaagttattgggcagcttaaagccgaggatttcgccaagccccttagccatcagagaatagccgtaaaaatcaaagtaaatctgcatgctgaatgcggtgagtccgagccaagctaatggggtggaaatgctctcatagcctatggccttcacatcattccagagtcctccgatttgatttgccagtaaaacctttaggcctaatccgatcgtaaattcgcgaagcccgttttccaggtgtaaaagtgagtgcctgcgtgcgctgatttgcttccggacagaagcgtacgtgacaatcggacctgctatcagctggggaaacatgcagatatacatgccaaaattgatgagggatggttcgaaacagatatccttccggtaaacgtctgtcaggtaggaaatggcctggaatgtgtagaagctgattccaatgggcaaaataaaggcgggacttgacagccggaaggagcagcctgtttcagcaagtaataagttaatattttccgaaataaatccggcatatttaaacagcacaagccatgagaggttgtaaaaaattcccgcagccagccatcctttccgacagccgcttttccttctgcgtccaagtcttatacccagacggtaattgacgaagacggaaaagagcagaagcgccgcgtagagagggtggtctttgactccaaatgagtagaataacaggctccccgccagaaggcaggagttcttccacctgcggggagtcaggaaatatacaaacaggaatatcggtaaaaaataaaaaatgaaagtaagactgctgaaaaccataaccaggacttctcttttctcataagtaatatttaataacaatagatagacgggcagagtgggcagaaagtttcaataaataaaaaatatatggcaggagacaatgacagatacgctgcacgaatgaaccggcgcctgacgcaatgtgcgcaaatgagaaaaacaatgagaaaacagctgacttgaaaaagtaaattccagtgcaaaggtgaattccatcaccatttaaaaatcagtataaatagtagatatttttaagcatatttctaatgtttctgctataattaggctaacttcttacgaaaattcatattttaggacagagaaaacaggccactggagttttgtgtgcaagactaaattccaccagccacattcaaaaaatgtgaaaagtttacttccagtccgacagcagatttttgtaagttagttaacggttatagcggatcagcttaggtgtcagattgacctcgtcgggggcaatgcgcctaagctgaagtgcttttaaagtatcttcgccaaaggattccaaagccaattcgtatggtgttttgccattcagactttcacggggcgtggaattgatatggtccacaatccgattcacatcccactgtgtcaggaattcaaaactggttcctttaggaagcaccatacgcagcatagtgtgaacattttcaacaccacctttctggccactgcgcatgggatcgcagtagtataggctgcagcgttggaacccgttgattccggtctctaatgcgtccgggtccccaaattcagagccacggtcagttaacgtatattcaaatagggaaagaaacttataagtgccaagacgcttctccaggtggtcaaagacaagccgtacagcgccttttgtacagcggttcatcagaaaggcaagaaatagtttctctttggtaaaatagaacgttaacaacgtttttctggactctcgtgaggagtggactgtatccatttctgtaaatgaattaagtactaacccttgaaaatcgagataggttctgcctgtaaatacagaacgatccgtaatctgggtcttgtggcatctacgtggtttgaacttgggttttcgctttaaatcaatgtttctggaagagaatagtcccttatcgatgtaggtgtaaatggtgcgtacagacatgcccagctccggatggtttacggcaatctgatagggagactgtccctgttcaatcaatggggagatgatcctatctttttgatgtaattcgtgctttgtaatgcttatgccgcttctggagtccttgagaatctggtggtacttacgatcagcaaagtgcgcattgtaggtatacttgtgagcaatcgtgcagtgagaaatcttcttgtcacaaccattgcagacatagggagccttgtccagccgggagcaatgttccttttgaaaatcggggcaggtctggttgcaggtagggcaggaagtacatttgatgccacaaacaaggatcttattgcagacgttcactttgcgacagttgtatcttcgtacacaaaagttctttgcattatagaaggagcccttgtgataccagtcggaggctctacgcaatttcacttctttggaaatggtagttggatccttgcagagatatttagcgatgtccttgaaagaacgccgctgatttaaagagttctcaataaaaacacgatcctcaagtgtgagatgcttctggttaccaggaataaatttactcataaaaatcatctccttctactgctgtcagaaggagatataaagatatcatgtatgtatgaaagagtaaatatcaactgtgcagaagtaaactccaccagacaaatggggagtggaatttactttttcatttcagtcaatgagaaaacactcctgccaaaccttgtatttaaaaaaaaaatatagtaaaattacccctgataaacttgagatggcggcaaagaaccggaaaggagaaaaaaatgacagtcacagatgtatccggagttggaaaagcagccgtatttttaattaagggtgaagcaaatattctgtttgaggcaggaatggcctatgcggcagatttgatgatagaaaatataaggagggagctgggagacgggcaggtggatgccgttctgatatcccattcccattatgatcatgtggccggtcttccggccgtgcgcaaggcctggccgggagttaaggtatacggctcagagcgcgcaagggaaatactgctaaagccatctgcactctccgtgattcgcagcctgagcggtgacgcggcagaagcggcgggaatggactgggacaggaattacagggatgaagatctcagagtcgatgtcgtgctggaggatggagaaaccgtcaaaataggaaatcacagtgtcctggcgtttgaaacaaccggtcatacgaaatgctcgctgtcctatattgtggatggtgaattgatgctgtgcagtgagtcggtcggggtgatgggaccttatggcggttatatgccggcttttctggttgattatatcggcgcaagggaatccattttaaaatcggcgaaatatcatgtgaaagaaattatattaaaccattacggcccagtcagtgaggcggataagccgcgaatctgggatattctgctggaaaagctggagggcagtaaaaaacagatgacggatgtaatgaaacggtgcacttctgatgaggaagcgcttaaagagctggagagagtttttcatggaaatgtagataaaaaggagcagccggatgaggcgtttaatatcaatgcgctcagtatgatgaaaacgctgaggagacagttcccggaggaattccggtgatacgtatcctgcatctatatttatagaagagatagcgcttcagccggaaaacaaaaggaaggacaggtacggtatgcagttaattgcggcagtggataagaactgggctattggtcataaagggcagatgctggttgcgatacctgcggaccagaagtggttccgccaggaaacgatgggaaagattattgtgatggggagaaagactctgctcactctgccgggggagagaccgttggacggcagaatcaatctcattctgacaacggataaaagctttaagttaaaaggagcggatgtctgccacagtgtggaagaggtgttgaataggatcaaatggtataaagaagaacggggatttacggatgaagatgttttcattatcggcggacagagtgtttacgagcagttccttccctactgtgatacggcgcacatcacttatattgattatgcttatcaggcggatacttatcttgtgaatctggacaaagagggctggattgtgacggaagaaagtgatgagcagacttattttaatttgtgttatgaattcaggaaatataagaggccataggaattaggcggatttttgcacatccggtatggcggatttgaacagacagcagtatttttggcggtgaagccacgtttttgcttgtctttatagaggtgaagtggtaaaatgtaggcaatcttttgcatatttattgccatcatccggcaacggcgccggttttgccggtctgccggaccgcataggccggtatacaaaagttaacgacaggttgaatagaacgaggaaacaggaggagaaacatgtatcagattttaaaagcggaaaagctggctgataaaatttatctgatggaagtggaagctcccagagttgcgcgctcatgcgaaccgggggagtttgtgattgtcaggatagatgaagagggggaacggattcctctgaccatttgtgattatgacagggaacaagggacagttaccatcgtgttccagacggtcggggcgtcgacggagcggatggcacttttgaaggaaggggacaccttccgtgattttgtgggtccccttggaaatccttccgactttgtgaaggaggacccggaggaactgaaaaagaaacggattctctacgtggcaggaggagtcggaacggctccggtatacccgcaggtgaagtggttaaaggaacacggcgtcaaggtggatgttatcgtcggctccaagacaaaggatctcctgattctgacaaaggagatggaggagcaggcggagaatctttacataacaacggatgacggctcctatggccgcaaaggaatggtaacggaggtcataacggagctggtggagaaagagggcaggcgttatgatacctgtgttgccatcggcccgatgatcatgatgaaattcgtctgtctgctgacaaagaagctgaatctgccgacggttgtcagcttaaaccctatcatggtggatgggacagggatgtgcggagcctgccgtgtgacggtgggagacaaggtgaagttcgcctgcgtggacgggccggagttcgacggccatcaggtcaattttgatgaggcgatgaagaggcagcagctgtaccggacccaggaaggcagggctatgctgagacagcaggagggcgccacacatcacggtggatgcggacattgcggaggtgaggaataatggaagccagaagagacatgatggttaaagtaccggtgagggaacaggaaccccaggtgcgggccgccaactttgaggaggtgtgcctgggttataataaagaagaggccatggcggaggcggagcgctgcttaaattgtaagaatgccaaatgtatcgcaggctgcccggtggcaatcgatatcccggcgtttatcgaagaggtaaagaagggagagattgaggaggctgcccgcgtgatagcgaaggcgtcggctctgccggcggtatgcggccgtgtctgcccgcaggagacgcagtgtgaggggcagtgcatccgcggtatcaagggagaacctgtttccatcggaaagctggagcgttttgtggccgactggtccagagagcatggctttgtgccggaggcgccggagaagacgaacgggaaaaaggtggcggtgatcggctccggcccctgcggcctgacctgcgccggggacctggcaaagctcggttatgaggtcacgatttttgaggcccttcacgagccgggcggcgtgctgacctacggaatcccggagttccgtcttccaaaggagggcgtcgtacagccggagatagagaatgtgaagaagctgggcgtaaagctggagaccaacgtgataatcgggaaatcggtgaccatcgatgagctgatggaggaagagggctttcaggccgtgttcatcggttcgggagcgggcctgccgaagttcatgggaatcccgggggagaatgcgaacggagtgttctcagccaatgaatatctgacaagaagcaacctgatgaaggcgttccgcgatgactatgacacacctctgatgataggaaagaaggtagtggtagtcggaggaggaaacgttgccatggatgcggccaggacggcgctgcgtctgggagccgaggtacatatcgtatacagaagaagcgagaaggagctgcctgccagggcggaggaagtacatcatgcaaaggaggagggaatccgtttcaaccttctgaccaatccggtggaaatcctgacggacgagaatggctgggtaaacgggatcatctgccggaggatggagcttggggagccggatgaatcgggcagaagaaggccggtggagaaggccggttctgatttcaggattgatgcggacacggttatcatggcgcttggcacctccccgaacccgctgatatcggcgactacggagggactgagcgtaaaccgctggaaatgcattatcgccgatgaggccgatggaaagacgacgaaagagggcgtgtatgcaggcggagacgctgtgacgggagctgcgacggtgatccttgcaatggaagccggacgcgccggagcccgcgggattgatgagtacctttccggtaaataatggtcacagtttaaactgtctgaactgttacaaataatgtgcttaaaggggccgtctgtattcgagcgcgttttcaaatacgctcgaaccgcctctcttaaaatgaatgcagccctggccggaacgtagagtgtcggccggggctgttgctgattgaaggcggtaatctgcgggcggagaccgcaggctgccgccggctggcggaaaaagatccgcggagtgcattttttataatattaaattgttgagggaatatgaaatgaagaaaaaggtagatttgctccatgagccaatcctgcccggccttacccggctggcagtgccgattatggctacatcactggttcagatggcgtataatctgacagacatggcatggataggaagactgggggccggggcggtgacggcagtgggtaccgccggaatgtatagctggctgtcacagggaatcgtggatctggctaaaatcgggggccaggtaaaagtagcgcacgctctcggcgccggcaatgaaaaagatgcggcccagtacgctaaatgcgcaattcagatgggactgctgtttgccgtgatgttcggcctgatttcgttctttggcgcaaagtatctgattggatttttcgggttgaaggatccggtaattattgcaaattcacagaattatctgaggattgtctgcgggctgattctttttccgtatatcaattcagtgcttacaggtatccttacggctaacggagacagtaaaacgccgtttaaggcaaatgtgatcggacttgcggctaatatggtattagatccggttctgatattcggaattggtccgtttccggccatgggagtagtgggcgccgcagtggcgaccgtcacggcccagattacggtttcatttatttttattctggctgtcagaaaagaagaggttctctttggcagcttccggttgttcaccgttaccccggtccgctatattaaagagattgtcacaatcggatttcccgcttcgattcaaaaccttatttatgccagtatttccatggtactgacgagactggtgaccgggtggggagacacggcggtggcgattcagagagtcggcggccaggtggaatcagtttcctggatggtgggagagggatttgcggcagcagtcaattcattcaccggccagaattttggcgcgggtctgtttgaccgggttaaaaaagggttttcagcggcggtgaaaatgatggggatctggggactgatgacgacatccctgctgatatttctggcggaacctattttcagtatttttatccgggagccggatgtactcggggccggagtggaatatcttcggattctcggcctttcccagttctttatgctgattgaactgacatccatcggagcgtttgccggtttaggcaaaacctcgataccatcagtcctgagcataatcctgacttcagccaggataccgcttgcaattgtgttttcctcgatgggacttgggctgaacggaatctggtgggcgcttaccgtatccagtgtggctaagggaattatcttttatatcgcatataagatgacgctgcggaaagtggagaaaagaatggggccggggttacaaaaaacgacgtaaatactcaaaaaaatgcctgtagttttgtgaaaagttttcagcaaaaaactatagacgaattgagggatacgtgagataatatgtacaagtatgatgtgataaaattaacaaagtactaacacattcattttgaaaggagtcttaaaatgatttattcacacgaagttgaaagtatgtgtccagtagcgcagggcgttaatcacggctgtgctccgattccggaagaagcaaaatgggtaaaatccagagaggtgaaagatatctccggtttaactcacggcgtgggctggtgtgctccgcagcagggcgcctgtaagctgactctgaatgttaaagagggaatcattcaggaagctttagtagagacaatcggatgttcaggcatgacacattccgcagccatggcagcggagatccttcccggaagaacggtcctggaggcgctgaacacagaccttgtctgcgacgcaattaatacggcgatgagagaactcttccttcagatcgcatacggaagaacacagagcgcattctctgaggatggtcttccaatcggtgcgggtcttgaggatctgggcaagggacttcgttctcaggttggtacaatgtatggaacattaaagaaaggtccgcgttacctggagatggcagaaggctatgtaacgggaatcgctctcgatgaagaaaaccagattatcggataccagttcgtaaatctcggcaagatgacggatttcatcaagaagggcgacgatccaactaccgcatacgagaaatccaaaggccagtacggtcgtgtggacgatgcggtgaagattatcgatccgagacaggaataagcgggataatcagcagggaacgtttgaaccccctgaaagagttacatagacatagacttaatagcaggtaaattattaaggaggatcatagagttatggcattatttgaatcatatgagagacgaattgacaaaatcaattccgtattaaacagctatggcatcgcttccattgaagaggctgagaaaatcacaaaagatgctggactgaacgtatatgaccaggttaagaaaattcagcctatctgctttgaaaatgcaggctgggcttacacggtaggcgctgccattgccatcaaaaaaggatgcagaagagcggcggacgcagcggcggcaatcggtgagggacttcagtccttctgtatcccgggctccgttgccgaccagcgaaaagttggtttaggccacggcaaccttggcaagatgcttctggaagaagagacggactgcttctgtttcctggctggccatgagtcttttgctgccgcagagggagccatcggtattgccgagaaggccaacaaagtgcgtcagaaacctcttcgcgttatcttaaacggtttaggaaaagatgccgcacagattatctcccgtattaacggattcacctatgttgagacagagatggattattacacaggcgaggttaaagaactctggagaaaatcttactccgaaggactgagggcaaaagttaactgttacggagcgaatgatgtgacggaaggcgttgccatcatgtggaaagagggagtagatgtttccattacaggtaactccacaaacccgacaagattccagcacccggttgcaggcacctataaaaaagagtgtttggaaaaaggcaaaaagtacttctccgttgcatccggcggcggcacaggccgtacgcttcatccggataacatggcggcaggtcctgcttcctacggtatgacggatacactgggacgcatgcactccgatgcccagttcgcaggctcctcctccgttccggctcatgttgagatgatgggtctgattggagccggaaataacccgatggtcggaatgacagtggccgttgcggtaagcatcgaggagagcgctaaagctgggaaattttaagaaaacaccgattttgatttgatataatgttagcaaagaaaagtagttatgtccgtatagcatagcaaaaacccagagagtggcagtttctctgggttttctttattagtgcgcccggcggcgcacgtctctaaccggtgaaagtccggaatccgcccggtggtgggaaggatatagccgaaggcaagggtgttcatcgtgaggtgaaatctgaaggaagccggatgtggggaacatactaacccatgggcaaatctctggtctgacggacagaaatcacatcaggccatgcgtgagggtaaggctgctgaacaagtcgaagcccaataaccacacggaatcacgtatggtaaatgtggcagatagatggagagaaagagacgtgtggtacccggggaggtctgtgcggaatgtcctgaaagggataaccattatcgaaagatagtgctgaacgtacagaagtcagccgaggtcgtagtagtcgagagatgaaggaccgaatcaacaggagtctttagtacaactgggaaaggaggaaagaacattgggtacagaaaacaaagatagctgctcgcaaagagatagcgcggaacgtgaagggtatgtgagagcgcaccgttctttccgccggatatggaaggaaagggacagtgcacagccggaactcttggaggagatactggagaagggcaacctcaacagagcttttaagagagtaaaggcaaacaagggagcgccaggaatcgacgggattaccgtggaggaaataggcgcatacctgagggaaaaccagaaagaacttatcgagagaatcagaaggggaaagtacacccccgacccggtaagacgagtggagattcccaagccagacggcggaatacgaaagctaggtattccaaccgtaaaagaccgcattttccaacaagccataacacagcgccttacaccggtctacgagccgttgttctcggagaacagttacggttatcgcccgggaagaagcgcgaaagatgccattcagaaggtgaaagagtatgcagagcggggatatatccatgcggtagcattggacttgtcgaaatactttgataccctgaaccatgagatactcctgaatatcctgcgcagaaatgtgagggacgaaagggtaatccagtggattaagaggtacttaaagagtggcgtgatggaaaacggagtagtcatggaaacagaagaaggttcgccgcaaggaggaaatctttcccccctgctggcaaacatctatctgaatgagtttgaccaggagtatcagaagcgtggagttgtatttgtccgttacgcggacgacatcgtgctgctggcgaaaagcgagagagctgccaagagactgctggagacgagcacgaaatatctggaagggccgctgaaattgaaagtgaaccaagagaaaagccgtgtagtcagcgtgtttgcaatccgaacttttaaattccttggctttacattgggaaagaacggaaagggcatatatgtccgggttcatggaaagtcatggaagaaaatgaagtcaaagctgaaagaacttagttcccgaaggtcagttcagagcatacgccctgcattagcaaagataaaagtgtatatgtgtggctggctgaattattacgggattgcggaaatgaagaaccgaatagaagaactcaataagtggctataccacagaatccgaatgtgtatatggaaacaatggaagaaaccgagaaccaaggtgaagaacctgcggaaaatgggagtgccggaagatttggcatggcaggcaggaaacagccggagaggatattggtttaccacgcaaacggtagcggtaaatatggcaatgacaaaagaaagactgataagcagtggcttttatgatttagccatagcttatcagtctgtgcacgtcaactgttgaaaccgccgtgtaccgaacggtacgcacggtggtgtgagaggacggcggttaatcaccgcctcctactcgattgtattccgtgatggcacctccttcctgctggaaagagtcaacagcaattgttacaatatatctattataatgacatgatgttggggtcaaaaggtcttttgacccctttgataccggattgctccgtactgcgtgctctcacaatcctcaaaaacattcgcaatccgctcatttttctgcgaaaaatggcttcttactcatgtttttggcgggtcccaagattaaaaatcttcatgcaagcaagcttgcatcagatttccaaccttttgaccctgttatcatgacattctgttacaattaaggtataatgagtggagactgtaaaaagggatagctcaggaggtacagatgaattctacttcgaaaaatgcagaaaacaaaacggtaaataatccaggaattgcagctaaatttataattctcagcctgattgggatttttgtgtttttcgttccgatacgggctggcggagccagcacaatcccggtcgaattcctggtaagttatctgataagcagttttaagccggtggtccgcctctatgcactggcggtgattttgatagccaccgttttgccttttatcagaaaaacgtggaaaaaagatgccttaactaccgtattcaccttcagcaaaatacttggagccgtttttacggttatcgttttttcgggctttggccctgagccaattatcagggctgaccatggtccctttttatttgaggcacttgttatccaggttggggtcctgctccccataggctccatttttctgacctgtcttatgaattacgggtttatcgattttatcgggcagtttctccggccaatcatgcgaaccatttggaaaactccgggccgttccgccgtggacgccgccgcatcctttatgggcggtaatgccataggattgatgctaacgaatgaaatgtataagaatcaaaggtacaataccagggaagcatctgtcattgccacgggttttcccgttgtctgtgtttcattttttattgttgtagcaaaaacagcctctatcatgcatttatggacacaattttttctgacttcgcttttagttacatatggagttaccgcaattactgcgcgtctgtatccactggcaggaaagtctgccggatactaccgggaaggagaaggggtccctgaagaaaaaccggacggacggctcattaaggcagcatggacagaggggctgcgggtctgccaggatgcaggaccagttctttcaaacattacaaaaaacgttaaaaattcctttggactaatcttggaagttttgccgaattttatgtccattggccttatctcattgatcttagaaaattatacacctgtttttgactggttcggttacttattttatcccgttacactgcttttacagattccggaaccactcttggctgcaaaagccgcgttcctgggcctggcggaaatgtatcttccggttctcgtagtggccggcgcaccggagagaactcgttttatcatcagtatattgagcatttcgcaggtcctgatgtttacctccacgatcccctgtatcacagctacggaaattcctgtttcactcagggaaatgatgattatctggctggaacggactatcctttctctttttctgatagtaccggcatcatatctgctatttctctggatacaatagattttatgtaatgacgaatctttccatcagagtgttctgccgggaagatatggttgaaaacatatggtccgtctgaccagaagggaaacaaatgaataaacgtaaggtaatcagaggtatcctgtttttacttgcagttccaatggctgcaatgggagtgtttataggttttcatggaataagcttacagattgagcgccggaaatttccacccattgggaaattggtggaggtgaacggccatcaaatgcatgtatattcggagggagagggaggggaaacgctagtatttctgtctggttccggaactgctgcgccagccctggattttaaggctctttacagcagactgagcagccgttaccggattgccgtggtggaacgggccggctatggattcagtgatacggccgatactcccagggatattgatacggtattagaggaaactagggaggctttgacgcttgcaggcgaatcaggaccctatattttgtttccgcattccctgtcaggtattgaagcaatttattggggacagaaatatccctcggaggtgaaggggattattgggcttgatgccgctgtcccatccctttatctgtcctggggggaagagacattaaataagagtgcagaaagcatggcaaaaatatcagtcttatatcaggcgggaatggtacggctgcatcccgagctatatgataccgatcctgcaatgaccggagatatattgtcagacgaagaaaaagcagcttataaagctgtggttatgaagagttttatgacaaagaatatggtggatgaggcaagatacgcttatgcgaatgccgcaaaagtggattccctggaaaagccggttcaaattccggtactttattatatatccgacggttctcaggttgtagagggatggagggacatcgtcacatcctatattgcatcatttgcagaatcacaatatgagtttttagattgcggtcactatgttcatgatgaaatgccagacgtaatcgcagaaggaagtataaaatttatcgattcactctctgattaaagggaatggttaatcaagcgttccatcatttaataagtgagaaaatgaaacattaggcgcaccgtccaatagacggatgcgcctaatgtttcaatgatttacataactgcagcggcctgccttatgaaagatctgcctgcataatcccgtccattagacagcgcaggaaacatgaatcgaatcggaaacatgattttctatatctaattagccagcaggtcagttaaaagtccgtggctgtggccttggaggcctaggcggctgcggaggcctggggggttcgggccttggaggcctgggcggctgaggaggccttggaggttcgggccttggaggccttggcggctgcggaggtcttggaggttcgggccttggaggccttggcggctgcggaggtcttggaggttcgggccttggaggcctgggcggctgaggaggcctggggggttcgggccttggaggcctgggcggctgcggaggtcttgggggttcgggccttggaggccatggaggctgcggaggccttggaggtctgggcggctgaggaggtctgggtggctgaggaggccatggaggctgcggaggccttggaggcctaggcggctggggaggccatggaggaagaaaattcccctgaacaaccactaacaaagcattggattgaggagggatgctcatagtcatggcggacgagaacacgacgtttacccacattcccctttgaaggcagcatatgcacattttttggccgaaagatgttaagatactggtatttctattgagatttaatcttagaatttgtatggaagtgttattcccttcgcgaacagcataggagaccaggataaatccgttagaattatcggtacatgaagcttcttctacaaaggcgttattgatccgcaggacatttccctgctgaattatcgttccgcgtggatcgttgctcatataggagtcaccataaaagattttattacattgtatgcaaaacagaaataatctgtgaggtcaaagcaatttgcaaatagcctttccttaccggtaaactgcagttttgcaacgattgcccgttattgagatattgtaatttgatgtgaatttaatctataatttacttaagtagagatggaacaggaaaggagtgaaatggaaaatgagagccagaatttttgataaggccagtcaaaccttttatcggtcagagatttatgggattgtaaatttcggtggagacaggtatattgccggaaaatgtgagggtggtaaacagatattttatctgatagactatcttgactatacatcggagccgccttaccgggtgaatgtcgaatgtattgacagtaatccccttcctgaggggatgcagtgggaatacagacagaaagaggagctgttagaccttaatctaatcctggagaaaaaataccatcatccgccgttattatctttcaggggatgcccgtttttattggagcagaaggaatggctggcagaactgacagccagacggaaattgcctgattacagagcggatgcagtggtgcccgatacgaaattgcagggatggaattacatagaggatagctgtgatataaacagtttgatggattatttcggcggatttcatgattccgttataagggaaatccactatgaaagtggcgattatatggaaggcggaacaatgtatttgtcaccctcctgtgccaaaaagctgagaatggtgtttgacagtagctgggcaaacagcattgagatagtttttgagtcggtcaggctgctccggctggtaccgccgggagaaaattatttgggtgatttatttaatgcatctattttcattgacaacttagaagtgtatttttacgatgaatatctgaaggaaaggccaaaatctcatgatggtacatgggttaaagcgttgggaatgagatggcgggtgattgtataaccgctccgcggagaatcccgcgagcgggattctttgatgaacagattcatgaccggacgggctttgtattacccatttccccgggagccatatcgaatatatccccggcagcggaaccgttattcctcccacaattgccgctgtgtccgtttgaaagaattgttcagatgacgggccacggcctgttccgccttttcaggattacggtcccgtatggcggctccgatagccagatgttcttttaaaacgatttcggcatcgatagagttgttatatacggattttacctcaaaacggagatagttatttagaagcatcgccgtctcgcggtgcatccagccgttatgggtggcggcggcaatgtcacggtggaacttatgatcgatccggtagagggagcggctgtccctggattccagattgtttttgagttcatccaggcaccggatcagtccgtttatttcttcgtccgtactgcgcagtgcggccagtctggcattattcttttccatcagcatacgcatctccagaatatcttttgcgtctttttctgtgacagggactaccttcacacctttaccgcggcagaaacagacgtatccctctttttgcagctcaagcaatgcttcccgcaccggagtacggctgattctcaattcgttgcagattgcttcctgagagtagatggctccaatacggaagcggttgtaaaggatggcatccttgataagttcataggcctgttctttaaatgtattcgtttggatatatcctccgcccagcagagattcatcgttcataattattaaaccctcccattaatccgccctatggagcagaatatattacatattaataagagtagtataacgataaaacagggaaattgcaatgaaatcagcaggagtgtttggcgagaattttaaattatacaaacattccctgggtaaaatgaccggaaaattgtatattaagttaaaatccaaaaaaattattgacaatcgtcagattcgtgtctatattatagatatgtagaatgtaatatgtaatatattactgagaggggaggcgggttttttcagtggcatgttgcaggaactgagtacacagtgtagagcaaataaaggaggagaagtatgttagtcgcagtatggattattacgttcctgttaattattggtatcggagtatacgcaggtacaaaaatcaaatctgcaaatcaatggtcgggcggagacaagacgatgggagccgtttctctgggctgtatatttgcggcgtggcagattggcggcatggcagtggtaggcgcagcgcaaaacggctataatttgggaatttccggcgcttggtattcaattgccgggtcgttctattttatcgcgctggcagtatttgcaaagattatccgggagagaatgccaggggaatcagtgcctgcctatttacagaaccggtttgatacgaaaaccacccgcctgtattcctatgcctggattgtttatggatttctttatattccgattcagcttaagacggtagccagcatcatccagatcgtgctgccgggcatgaacatgatggcggcgatgctgattggcgttacggttgccgtactgtatacaagcttttcaggaatgaaaggcgcatctgccgtaggccgcgtagtttgtatcggcatctatatattgcttattattttcacggttacgaccctgtccggctttggcggactcggcggtttattcgaacagcttccggaaaattataattctatggggaatatgccgacacagagaattattgcatggattctgggcggctgtatcagtacggcagtcatgcaggcagtgcttcagccgcttttggcggcaaaaagccctcaggctgcaagaaccggttcaattctgggctatctgattgcggcgccgatctgtttttttacggcaatttgtggtatgctttcaaaagcttccggtgcagacctgggcgacggttcgacggcttttgcatatgcaattaaaaccttcagcagtcccgtgtttgccggaattatatttgcctttgcgaccatgattatcgctgcgacaatggctacgatgatgctggcgacgggcactattattacaaatatatacaagacggaaattgaccggagtgccggagatcagaaggtattaaagatatccaaatcggtaacctttatttttgcctaccttaccctgatacctgcatttctgattcccagtcagtcacttaccaacctgtttttaacactgcagcatgtagcggcggcaccggtcagcttttcgattctggcaggcttaatgtggaaacggtgtacgaagcagggcgcattctggagcatgctgacaggcatgatagtggggatttcctggatgcttcttgggttgactgataagatggaagcagtttatccggttgtggttgttacatattcagttggaattattgtctcgcttatgacgagcaaaaaggagatagtttaatatgtgtcaggagcaaaagaaacagatttatatgtggccttctcattgggagaaaccggccgcacacggagattacggcgctgtgagctgcaacaacagttatgcggcgagagccggtctttggatactgaaaaacggaggcaatgcctttgatgcggcggcagccgtttcgctggcattgtcggttgtggaaccgcatcattcaggaatagggggaggctgcttcagccttctctactgcgaaaaggagggccggatttttgccctggacggaagagggacagcgcctgtgcaggccggacctgatttgttcctgaaaaacggggaagtgcaggatgaatggaaggatcttggcggacagtcggttgcgattcccggattactgaaaacgatggaagacatgctgaaacgatttggcacaatgacgttaaaagaagtcagcgttcctgcaatccggtatgcgaaagaaggatttggcacgagttacaccggcgccctgaccatgtatgatgattccgttaagagaaaaatgagaatatcggaaggattccggaaattgtatttgaagaatgggcaggaattttaccggtttggcgatatccagaggaatcctgagctgggagtgcttcttgagacgatagctgagaatggaaccgatgtattttaccgcggggagatagcgcagcggattgtatcggtgattaacagcagggggggatgctttgaaacggcagaccttgagaattacgctcctaaataccgtgagccggtacatacggattaccgcggctatgaggtggtgtcgtttgcgcctcccagcggaggctgtacgttgattgagatgctcaacatcctggaacagaatgatttaagggccatgggacataatacggcagacagtattcatgcaattgcggaggcaatgaaattgggttttgccgaccgaagcatcgctttgggagatcctgattttgtgtcggttgacacggagcgtcttacctcgaaagcttatgcggcgaaacggttccggctgattggcggacatgccggagaatatgcaccggcagagggcattgaggcaaaagagtatccgggtaacacctctcatttttctataatggatcgttttggtaatgcagtttctcagacgcagaccgtacgggactggtttggaagcggaattgcagtggagggactggggtttgtactgaataatgcaatgtctgatttttcagccgccgccggggccatgaccagccagggcctggcttatggaaacgcgaacagcattgcgggaggaaaaacgcctctgtcaagcatgagtccgagcattgtcctgaaagacaaaaagccgtatctggcgattggttcggcaggcggaccgagaattattacaggaactcttcagggaatcattaatgcaattgattttgatatgaatccggaacagcttgtcaatgctccatatgtgaactgccttacaagggagcagggactggaggcggaattcggtatttctcaggatacgctcaggctgcttgaagagagagggcataaacccgtatgtatagaagcggatcaggcgatgagcacaatggtcaacagcgttatgcttaaggatggggagtattatgcagccggaacaaagagagtggacggctgcggcggtgttctcttatcaaatggaaatattattttagaagggatcagccaggagatttcctgacgcaggtttggctgtttcgtataggccgccggagacgacctatacgaaacggtgaagaaagcgaagaattttactgtgaaataaaaaagtttccgcttgtcggcccctgggctttcagcagaaactttttttatatggtttattagttgttaacagttacgttaacagcctgtaatccacgagcgccttctgtaacttcgaaggaaacggactgtccgtcttctaatgttttgtagccgtccatagcaagaccggagaaatgtacgaaaatatcgttgccctgctcgtcgctgatgaagccgtagcccttctgtgagttaaaccattttactgtacctttattcatgaaagatacctcctattatattatttttattatattttctatataaaacaaaaaatcacatatctttgtaaatcaacaaaccgatttacaacaaatatgtgaaatcaaagctttatcaaaaatacgagtttaatatagcacgctctggcggttttgtcaagaaagatttaaaaatttacatcagatttagcaatattttagtataaacgcgatttgccctgccggaaccctcaatcgttactgttcaccctccgccaaaaagcggcatggtgcgaacaataacacgcttcgcgatgcacagaaacggcaaaaacgccgtttcgcgccgtggaactcgggattttcgtgcagaatacgcacgaaaacacctcgcggaacacaaccgtgtgaacagtaaccctcaatccgcatttaactgtgttaaaaaaatgataaaattgcaatgtttttccatttattgtacaatgaaaatggaaaggttactgttaatgtgagaaaataagatgaggggagaaagagttatgagtaatacgaagaaaaagttaccgttggctttctggatttttacaggtcttcttctgggtatcctggctggtatgggattaatgaaaacgccggagattgcgaccacgtatattaagccattcggcaccctgttcctgaaccttgtgaagtttattgttgttccgattgtgcttttctcgattatgtccggcgtgatatccatgagggatatacggaaggtggggagcatcggggtaaaaaccattgtctattatatgtgtacgacggcattggctgttgtgattggcctggcgcttgccaatgcattcaagggaagcttcggcgagatatctgcctcagggctcgaatatacggcaaaagaggctcccagctttatcgaaaccctggtcaacatcttcccgagcaatgtgattgggccgatgtcggaagccaatatgctgcaggttattgtgatagcgctgttttttggcttcggcgtgatttcagtcggggaaaaaggaaagccgttcgcagattttgtggagagcgcgaatgcaatctccatggtgattatgggaacaatcatcaagttcagcccaatcggtgttttctgcctgattacgcccgtagtggcggaaaacggaccggatattctgggtaatctgctggcggttctgctggtcgcctatgccggatatatcatccatatggccgtagtatattcgtttacggtaaaaacgtttggtaaaatcagccccctcaagtttttcggaggaatgtcgcctgcaatgattatggctttttccagcgcttcttcggtgggaaccctgcctcttaatctggaatgcgtggaaaagatgggcggaaagaaagaagtggcaagcttcgtcctgccgctcggagctacaatcaatatggacggtaccgccatttatcagggcgtctgtgcaatctttatagcaacctgttacggcattaacctgactttgggacagcagattacaattatcctgacagccacgctggcatcgatcggaacagctggggtgccgggagcaggaatgattatgctggccatggtgcttcagagcgtcaacctgccaatcgagggaattgctcttgttgcgggaattgacagaatattcgatatgggcaggacgacggtcaatatcacaggcgatgcggcatgtgcgctgattgtttcgaaaatggaggaaaaaagcgcgcggcggtgaaagcagttaaaaacaatacatagaaaaagacaggctggcaggagacggagtttaacggataggagccggcccaggaaggacattaccatgtgaaaacggtggcctgtacgcagaacgtgcaggctatcgttagttgtcagaatgtacggcccatgatagaatgataccagaataacaaacagggagaaatgccatatgaaatctttagttttagcagaaaagccctccgtggcccgcgatattgcccacgtgcttaaatgcggcaagtcattgaacggagcgatggaaggccaggaatatatcgtaacatggggactgggacatcttgtcacgctggcggatccggaggactaccatccgcgctacaaagagtggaagatggaggatcttccgatgctgccggatgagtttaagctggatgtcatcaaacagacgggaaagcagtataacgccgtcaagacacagctttaccggaatgacgtgaaggatattatcattgccaccgacgcgggccgtgagggagagctggtagcccggctgattctcaaaaaggcgggcagcagaaagcccatccggagactttggatatcctctgtcacggataaagccatccgggagggatttgcccatttaaaggacggaagggagtacgataatctttatgatgccgccatgtgcagggcggaggccgactggatggtgggaattaatgccaccagggcgctgacctgcaagtataatgcgcagctctcctgcggacgtgtgcagaccccgacgctggcaatgattgcaaggcgggaggaagagataaggcaattcgtccccagaccatatttcggaatacggggagaaagccgccatccggccctgacgcttacctggcaggacggagggtcaaagagcgcccgctcctttgaccggaaaaggatagaggagctggttcagggacttcagggcaaacaaggtgtggtggaggatgtgaaacgcaccccgaagaagacgtacgcgccacttctttatgatttgacggaacttcagcgcgatgccaataaacggttcggctactcggcaaaggagactttgaacatcatgcagcgcctgtacgaaaaccacaaggtgctgacctatccaaggacagattcaaggtatctgagcgccgatatcgtaccgacgctgaaagagcgcttaagagcctgcggcacaggcccatataagaagctggcggggcggcttacgggccgtcctctcccggaaaagctgtttttcgtggataacggcagggtatcggatcaccatgcgattattccgaccgagcagtttgtacagctggaccatatgacagtggatgagcggagaatttacgatctggttgtccgccgtttccttgccgtactgtatccgcctttcgaatatgagcagactgctctcacggtaaaagcgggaaatgaatgctttactgccagaggagaaattgtaaaggcgtcagggtggcgcgaggcatatgaaaatgaaagagaagaagaggaagacgcagagggggaggaacaggatgtaaaggcccagaagcttcccgacatcaaaaaaggagatatcctaagcagtattacgttccgtatgacggagggaaagacaaagccgccgtcgccgtttaacgaggctacgctgctctcagcgatggagaatccggcagcctacatggaatcaaaggatcgggagatggcaaaaacgctcggtgagacaggaggcctgggaacggttgcgacacgggccgatatcattgaaaaacttttttcaagcttcctcctggagaagcgggggaaggaaattttcctcacatctaaggcgaaacagcttttgaacctggttccggaggatttaaagaaaccggagctgacggcgcagtgggagatgaagctttccaaaatagcaaaagggaatttaaagcgggacgcttttatgaaggacatcagggaatattcgggtgaactgatttcccagatcaaagcaggggagggcagcttccgccatgacaacctgactaatacgaaatgcccggtctgcggaaagcgaatgctgctcgtaaaagggaaaaacagcgagatgctggtctgccaggatcgggaatgcggccacagggagacgatcgccagaacctctaatgccaggtgcccggtctgccacaagaagctggagctgagaggaaagggcgaaagtcagatcttcgtctgccggtgcggttataaagaaaaactgaaggcattccaggagagaaggaagaaagagggcgccggggtttccaaaaaagacgtggcaaaatatttgaaccagcagaagaaagaggccgaggcaccgcttaacaatgcgtttgcacaggcgctcaagggaattaagctggacaattaacggccggaagcaaattattacattagatgacagaagcagggggacaaatggataagaataaaatcctgataatcgaggatgaggcagccatccgggagctgctctgcatgaacctggaagccgtcggatatgagacggatacggcctgtgacggtatgcaggcggaacttaagatagaggaagacaggggagggtatgatctggcccttgtggatgtgatgctccccggacgcgacggttttgatctgatcggagggctgaataaaaaagagattccctgcatatttcttaccgctaaagcggatgtggcttccaaggtcagggggctgcgcctgggggcggaggactatattgtaaaaccgtttgaaatgatggaattatttgcgagagtggaaaatgtcttaaaacgcaggagtaaactgaagaatacaattgaaattgacggctgccggattgatttgaccggccataaggtgtttgaggaggggcaggagattcagctgaagccgatggaatacgatttgtttctttttctatgccgcaaccggaacgtggcttttacaaggaaccagcttttagacagaatctggggcggtgattatgagggagagacgagaacggtggatgtccatgtcgccagtttaaggaaaaaactgaaggcagcatccaggatacagacaattcccaagctgggataccgcctggaggtttaaagcctatgaagcttacaaaaaaactgctgctcatcatttccgccagcctggccggagccctgctggcagtcagtattctggcaatctggcagatgcgttcccagagtatttccatggctgtggacaattacgacaggcagatggactcaatttcctatgtgttttctgagattggcaccagggaagattttgaggccatgggggatatcgccgctgaggcgtatttgaaataccagttccgaaagtgctataaagatggctatgctctgctgaaagggagtgagagcatcgtcaatctgaccgattatgagattctggctcccgatatcctgaaggagccgtatctgattcagcatctgggaaaacaggcagtgctgctgatgaagagagaaatcacccagtttcccggctacgatgtgctgatggctcagaatattacgccctattatcaggaaatagaacggcgtgccgcgtatctggccctgctttgcacaggtgtttggctgataaccgtgaccgccgcttttttcctgacccataaggcgctgatgcctctgaatgagctgacaaaggccgcggtaaagattggtaacggaaatctcagcgagagggcgccggtgcaaagccaggatgaaatcggggaatttgccgaagtctttaaccagatgacggaaaaagtggagaaacaggttgaagatctgcagctgctcctgggggctctggcccatgagataaagactccgatgacagcggtgattggttattccgacagcctgctgcacgtgaatttatccggggaacagaaagagagggcgcttaaggagattcaccatgccggcctcaggctggagcgtctgtcttccaagatgttaagctttctcggctcctatgagaacgatgaaatccggtttgagacaattcaggtaagagaattattgcagaacgcgctaaaagataccaagccaatttgggaagaaaaacagattcaaatcgagtggaatgtgcaggattttccgctcagggccgacagggagcttttcctttctcttctttataacctgattcataatgcggtaaaggcatcggagccttccaaaagattgtggattgaagcagataaagagaagaacacgattgtgataagggacgagggctgcggcatacctgcaaaggatctgccgcatgtgacggaagccttttatatggcggataaatccagaagcagaagcgagggaggctccgggctggggctggccctttgcagaaaaattgcatcgctgcattccgtcaggtttgagataaagagtccctgtgcacccggaaagaatacgggcggaaccgaagttaccctgcaccttcccgtttacaaaacgtttacaatttgatgaggattttgacgccgcaggaaggtatactgtgagtacttagcaaagaaggataaaggagtggagagtaaatgaaaagaaaattatcaatccgtctgcttcttgtgacggctgctgtgacaggactcgcttcaggctgcggcacaggcgcgcaccagcaggtaatcggtgagaaacaggaaacacggaccgagcaggagaatataacggaaggcacatcggctgacggcgcggccgaccggcatgaactgagagtggcggagcaggtacaggctccggagcgttataaaacagaggtgaaggataaggggctgtatctcacggcagatgcatcagttgaggttcctgatttggatcgtgccctgattaagaagtcacgcgccgttaattttacaaaagaagaatacgagaaggtaaaggaagtattatcgaaagaactggagcttgagtggggagaagggaagacggaccggcgctatcttcaatatgaaggaggagtctgggactatgtggatgttacggatgccgacaatgcggaaataatcaagaaggcggaaggcggcagtgaaaacagcgcctatgacgaggtcacgaatgtgagcgggaccggcgcggacggaagcagttaccagctcagttaccggacgggcacaggggatatcacaccgcccacaacgctgatttggctgtcaaaacgaatagaggatggacgctacatcgacaaaacggcagtcatccataagagcggggacgaagaatccgccgcacggtccgagcttgccggacagcttcaaaagaaagcggaggcgctggttgcagaagccggattcaagaactataaggtttataacacaagatggagggaatcgttctaccgcacgaaggaggggaatttatccgaatttgtgtactggctcacatttacgccttcgatagacggaatcggatgcacctggacgaatgccgacctgatgggaaactcagtgctgaacggcccctatatcgacctccttttaaaggaagacggtacgctgaactatatgaggataatagggaaggaagagatagagaacagcggcgcggacggaacgtttcttctcccctttgaggccattcaccagctcttcgaacagtattgcaaagacttttatgggaacagcggtgaacaggagggggaggcggttctgaaggacgggaaaacgcagataggacggacagaagccataacccgcctgaatgtcaacagtgtcaggctggagtatgctttcattaaacgggaaaacgccgccgccaactcggagcaggaactgatacctgtatggaacttttacggaagcatatcacgcggcccgacaatcggagaggaagacagaccgcagggcatggtggagaatgtaattctgccggaagggattattctttccatccgcgcggatgacggtcggattctggtggaataaatatgttgatggaatgttaaaaaatgataagataaccggcatcttttattaatacaataataacctatctttcaaatttctttatatttacaaaagaaatcagacgaaaatgaaaggttaattaaaacactgataaggaacggccaaaccccttccctttttctaaaaccagaatacaatgaaggtaggttgaaaatagaaaaaggagggacgacatatgaacctggttgctattttacttattattgtatatggcatcatcggaggactttccactgcggttcttaccataagcctgccggtgctgattatctggaaattttacaggaagtttaaataccataaggcattgaccgattagttaaaaagatgccgccaagaatgaaaaagaatatggaagatcggataacatgagttgtcagcagccgaaagaacccggcggcgggcaactcatgttttttcttttaacaggaaagttctcctgataaataaaccgcgccgcggtgaaaagttcgcaaagcgcgttattgttcgcggctgcgggcgaagataaagtctgcggagcacactcccgctctgtgaaacgcatcgcgctgctaagctcgacaggaaattgcggaagattttgatatcagcctgccggaaacacgtagtggccgcgacagggtcctccccatttaaggttggaaacaatcagcggccggaacggaccttgtccggtgtgcgaaaaccttcgcctgggtcatccgtccccggcgaaaacctgaccgggggaagtaggcggaatcaattgcggaggggacatgggagtccgccggtgcttggcgaggtccctcacgagcttagcactgctgcgcactccaaaagtgcaaacggtccccgcagcaattcattcctgtcggattcccccccccacacgacaacctccaaccggggacggaagactcagccagcctcccctcaccacaccggacccggtccgttccggacgcgtcctccgggcctcagttaaatctaaatgacacaaccgtgtgaacagtaacccggggctgactctttattcgataagtccgaaagaggtatttcacggattcagcagacatggtataatttaattataaacaaaacaggagggagccatggatttagatttactgaagctgttcggcacactcaggccctacggcagcagaacgaatgaccgcctctttttacgctccataagacgcagggcggcctatttcataaaacactccccggagtaccgtgcaatctgtgaagatgccggtttccatccggccgttttaaaaaacatgaaatcgttagagcagattccggtcatccccacactgtattttaaacggaataaaataggaatcaggcgtgggccggcagtggaagtcacttcctccggaaccgggggaacggccagcaggcttagttattccgtctgggagatatgtcttttggcggcaatggcagtcaatctcgggcggattcacgggctcttttcccgcaggccggttcattatattatgctgggataccagccctcaaaggaaaacaaagcggtgatttcaaagacagcctggctgtccactctgtatgcgccggcaatcagcaggcgttatgccctggaataccggaagggcgtaagaggagaaagcggtacctataccctcaatctgccgggaatactggagaatctggcgcgttgtgcagagggcacacatccggtcaggctggttggttttccctcctatacctattttttactcaaaaaaatgaaacaggaaaacataatatgccggctcccgggggactcccgtgtgatgcttggcgggggatggaagcagtttgagaaagaggaaattccaaaagaggaattatacacgctgatttgggaggtccttgggataaacaaaacccgggtgcatgaatttttcggcgcggccgagcatccggttatctactgcagctgcaaaaaccatcattttcatattccggcttatgcaagggttttgatccgcgatacggagacgctggaggcgcttcccaaaggccgcgccgggctggtaaacctgttgtcgcccattggttcggatctgcctctgatgagcgtgatgacggatgacattggagtgctgcatgacaaaaaagagtgcggctgcggcattaaaagtgattatctggagattctggggaggacgggggcaaagggaatacggacatgcgccgccggagcggcggactactggcagggaatatatcgtccggcaaaatagcagaaaacagagcggtacaagcggcaaattctccggtagtgtataaaataaagtaaagccaacgaaggattatttttatgaagaaaagaattccgctggaaaaagcagcccttcaggtctgtattgatagtgaaaagcagccccgcatttatcagttaacgccccgtcagggcagaatcaagctggatgaggtgcaggacgcgccggtagccatgtacccggcgtcggtatgcaccgtgaattttgataccggaagatgggggattattcgggtatttattgtaagaccggaaaattataccggaaattcaggcactattttttacatccatggagccggctgggtattcggaaatttccatacccatgaaaagctggtcagggaactggcggcccgaaccggttcgctcgtcgtatttccggagtacagcctatcgccggaggctaaatatcctgtcgccatagagcagtgttacaggctgctctgtttgcttcctgctttcacatatggtacgggagggccgtttaaccttgaacggctgaccgttgcaggggacagcgcgggagggaatatggctgctgcgctgacactcatggcaaaatacagaaacggccccaggattcacaggcagcttttgttttatcccgtaacggacgcctgctttgatacctgcacctatatgaaattcgcaaaagattattatctgtaccgggacggaatgatatggttctggaaccagtatacggcgaatgaggctgagcgcgcccagataacggcgtccccgctccgggcctgtccggagcagcttgccggactgccggcagcattaatcataaacggggaggcggatgtactgcgcgacgacggcgaggcttacgcctctaagctgcttctggcgggagtagatgtgacggcggtcagaatcagggcaacgatccatgactttgtaatgctgaacgccctcgaccagacgaatgcatgcagggctgcgatggatttggctgtaagctggctggaaagaaagtaataaaggaagataccggagagaaagaggaaatcaagatggtttttctggatggacaaataacggattttgccgataatatcgaggcggtaaaacagataaaaaagaagattgtaaaaacgctttcgggagggagcctggatccggaaatcgtgattcaggctgcagaccgtctggctgccgatatcatgtccggcaggtcatgcatggcggatggggaatggcctgcgataagccgggattatccgcctgcttcttttgccgggtatttcacggcagattctctgaggaagaaacgaaggctggagcttccggaaataccggactgcccggaggagggaaaacgcttttttagagaacctctgggagtgctgctgcatatcgcatccggaaatgcggccggtctgcccgcatacagtgttctggaaggactcctggcaggaaatatcaatattctcaagctgccctccggggccgggggcctgtccctttatattttgaaaaaactgacggaatacgaaccgcggctgaaagaatacatctatatactggacacgccctccggtgataaaagggtgatggagatgctgatgcgtctggccggagggattgcagtgtggggctctgatgagacggttcgggcggtgagggagagcgccccggttaatgtcaaaattatcgaatggggccatcggctgagctttgcttatattgcagatatggatgtcccggaagtaaaacttgaaggcctggcacgccacattttcagtacaaaccagcttctttgcagctcctgccaggttgtttatctggatacggataactttgaggaggtaaagaagttcggcctccggttctcattagtgatggagtgggaaggaaggcggtatgggaatccgctgtttatcaggggaaaaacagccgttgagaggctgacccaaaagcttgagcttgccggaggaacggaaaggaacgggaagaaaggtccggccgaacgctatatatacccggccggtcatgggagcgtgacctgtataaacgacagcagactggaattatccgggcagttcggccatgtcctggtcaagccgcttccccaaaaaaagattttctccctttatccatgtaaaagacaccttcagacagcaggaatttatccggaaagcgctagtctgataaagacattggcaagatgcggcctgacgaacttatgcagtcttgataatatgggcagttttggaatattgagttcccatgacgggacattcgcattgcgggaatacacgaggattacggaatataaaacaggaagtgggggaggattatgaactatctgattgggattgacgtggggacatcggcgacaaaaacagtgttatttgatgaagaagggacggtgattgcttctgcctctaaggaatatggaatgattcagccgcagaacggctgggctgaacagaatccgggggattggaagaatgccgttcttgagacgctttcagaagtcagggagcggtcgggagttccggccggggcgataaaaggaatcgggctttccggacagatgcatggccttgtgatgctggatgaagacaatgaggtaatccgtccctccatcatctggtgcgaccagagaaccggcggacaagtggaggagatgctgcagattatgccgcgggagaggtggatagagctgactgccaatccgccgctgaccggctggactgcggcaaaaattttgtgggtaaaaaagcatgagccggagaattatcaaaaatgccgccatatattgctgccaaaggactatatcaggcaggtgctgaccggcgtgtttgcaacggaagtttcggatgctagcggcatgcagcttttggatgtgcagggccgctgctggtctgaggaggttctgcgcgctctggatattgacaggtcccttctgggggaggtatacgaatcctgtgagataacgggaacccttctgcctgagatagcggagcggacaggcctgaatgcggatacgatagtggtcggaggagccggcgacaatgcggcagcggcggtggggaccggtgttgtagcggacggcgccgcatttacaacgattgggacatccggggtggtatatgcccacagcagcaagcttgccgtggatccgaaggggagagtgcatacatgctgctgtgccgttccgggagcatggcatatgatgggagtgacccaggccgccggtttatccctgaaatggttctgcggacaattctgccaggattatatggtggaggcggagcgtcagggaagagatgtctatgatttagtgaatgaagcggtccaggagataaaacccggcagtgacaggcttatttacctgccctatctgatgggagagaggacacctcatttggatccggactgccgcggcgtatttttcggactgtcggccatccatgcgaaaagccatcttttaagagccgtcatggaaggagttgcgtattcgctcttcgactgcagcgaaattcttggggatacgggtgtgaaaatcacagagatgatggcctgtggcggcggagggaaaagtcctgtctggaggcagatgctggccgatctttacggctgtccggttaagacggtgaagcagcaggaaggtccggctcttggagctgcgatactggccggcgtgggctgcggtatttatgacagtgttgagacagcctgcggccgtctgctgaggatgagcagcagcacggagccggaggaagaaaacacggtgctctacagacagttccattgtctgtaccaaagactttatagcagtctgaaagaagattttaaagagcttgccggactgtaagacggtgtgtgaaggaaaaggagacgccaaatgatacctgctatagaaaacagacgaagcatggcgttaacagtactttaccgtaaacattcaaatccctccttcatatcataaagaaggagggatttattatgtcagaacgttcatacacacccagagatatttttgcagatattcttgaagacaatgaaccgcaggctgttgcctgggtcaggggagatgccgctcatccggccttaagcggcatgatcaaattttataagacgccgtatcagggtgtacttattgaagccgaagtattcggccttccggatcagggacggccgtctcagagcaattactatggattccatatccacgaaaatggaaactgcagcggtacggcggcaagcccgttcgctaacgccggttcccattacaacccgtctaaagcacctcatccgttacatgccggtgacttcccgcctctgctgagcaatcaggggtatgcctggatgtccttctatgataagcggttttcgctccaggatattctggggagatccgtaatcatccacaaccagcccgatgactttacaacccagccgtcaggtaattccggcgcgatgataggctgcggcgtaatcatgaagaattaggtcactgttcacacggttccgttcctccggacttcagtttcaccagcagcctgcgggtcaggattaccgaagtgatggtgtaatagatttccagcgcgctgctgacgattccgaccagtatcaggaggaaagccgaacctgctacgattcctgcccacgcaaagaggcaggaaccgtagcgggacggatccgtgcggtattctttcaggataatcaggaaaagactagccagcagaagaacggcggccataaatgcaaatataatatgaagaaacgatttaaacggcatctcctccggcagatagggggtagtgatggcacaaaaaagcaggacaagtgaagagggaaccaggaaggttccttttggtttctgtttcataagccggatagcggtgcggagagagtagtagaaatacgctcccaccagaactccccacagaacgaaggcgtctttcctgtgcagatagttgccgataacggaaaaattcgttgtaaaccacccgtatcctttgacaaaaaggatggtataagccggaataataatataagctatcaggttaagcataatgcaaaaattcctctccaaataaatttacaaaagagtagtataccagaatgtaaaagatatagggtgaaattattatagtatttttgttaaatttttataatactgtaaattttgttttttaacagctttataaaattccgtaaataacctgcctgtgcaggctattgtcgctcataccattaagcaggttttaacctaattatccgttaattctttaattgctttgactattctgtttaatccctcttccagcatgctttgcgggcaggcaactgtcattctaaaatatccggctccggattcgccaaatacatgaccgttttcaatcaataaatcatactttgttatcagtaattcaaataatttttcgtaatctacatatgctccaaaatttatccaggctaaaaacgtcccctcaggctttttgtattttactttcggaagatgtttattaagataatccactaaaaaatcaaagttctgctcaacatattccatgacttcatcaacccaatattcgcatttattataagcggtctctgctaaaaccatatcaagcggcggggcaaaactaatataatgttttttccttgtttctttgtgccatatttgttttaactcttcatcatctatgattatttgtgaaattggtacccctccgacattgaaggttttgcctaaagccacagcagtaataattttactgtaatcacttatcgtcttaagtggatgatgcgttacattagctcgtgttaaatcgcaatgcagttcatcagagaaaattaaaacttcgttttcttgacataaatcgactattttctttaattcattctttgtccataccctgcctaccggattatgcggtgaacataagattagcattgtattattaggatcttttaatttgttttctaaatcaataaaatcaatgctataattctcatcgttatttattaactgattattaactatttttctatcagttccttctattaactcggcaaatggatagaatacaggctcctgaataataactccttcccctttttttgtaaaacctcttaagataaaacccaatgcaggcagaacacccggcgaataaaagatggaatcttttgaaatggtccaattgaatcgtcttttataccatccttgaacagattcaaaatagctgtcgcccggcatagaatgtccaagaaatccatgctcaacccttttaatcagtgcttcagttatttcatcagcaactttaaattccatatccgaaagccatagaggcaatgctgtgtctgatactctgctgtccacaaaatctttatgatcccatttgacacaatccgttccttttctattgtatagcttgtctaaaattaattttcccatagcgccgctccttttactattttatatatctcttattatctataacacagaagattgtgaggaacaacttaacagaattccaaatagagggcgataaaaattaagattgtgtcatcacagtagacgtttacacgtaatttagatataatgtgtatataaaactgctttactacgctaaaatttatgcttttagaacctttctgtgaaacgaggtggatttatatgtcggaatacctgatggaattaggcagcattcttagaaaagtgagaaaattacgtggtttaactatccaacagctagcagataaaatccagaaaagtaaatcaacgttgtcaaaatacgagcgcggcgaaatagcaatagatattcttactattaaggaaatttctcgggttttaaatataagcattgatgagttattacctggaaccgctgataattcaagtcaacattgctatccttccactgcaaatgtcccatcattttttaaaaacaatacacgtttttattcttattattatgatggccggaataaaaatataatttgttccgctttattggttaaaaatgctcatgatgataactctatcggtgttcatatgtacatgaatataaaagatataaattaccctcaggcatgtgaaaatacatactatggtctgatgactcatcatgatataattactagaatggacttcattaatcgtgatacttcagtagaaaaagcatcaatagctattctctctccatttgttgaaaatgatgaaagatgggggctttggtcaggaatttctacaaggccggtaatgccggcctcaataaagatgctctttacaaaaactccccaaaagacagacatagacctaaaaaagaaactaatgttaacacaagaagattacaaactaataaaactttataatatgtttaccgtattttaaacaatacaatcaaagaaacagcagtgaggaacagtctgtccccggccgtcataaactaaaagaaaaaggataacacatttatgacggtaaaaagtgtcaatacaagaaatctgacgaaagcggaactggataaagaagacgcgcgtattaaagagatgacggcggcagagcttcgtaatttcagggagagctttgacgcggaccagatgggttttgccggcaggaaggagggtgtctgatatggaaatcaaccgtcttctgacgccatataattacagcaacggtctggagagccgtatcaaatacattgtaatccattatgtaggagctacaggcggagcaaaagccaattgtgagtattatgcaagcaaatacatcggggccagcgcccactactttgtgggctttgaaggagagatatggcagtcggtggaagagcgcaatatcgcctggcattgcggagccaatgcatataagcatcccgagtgccgcaattccaacagtatcggaattgagctgtgtgtcagaaacaaaggaagccaggcggcaaccagccgcgactggtactttgaggacgccacggtgcgttcggctgtggccctgaccagagagctgatggaaaaatacaagataacggcagaccgggtggtccgccattatgatgtcaccggtaaaatatgcccgaatccttttgtctataatcatacggatcatacctgggaggagtttaaagccgcgcttaaatcagccggtttcacaccgggctgggagaaagatactttgggcagataccgctatgtacaggcagacggcacctatgcagttaataaatggctgctgattaaccaccattggtatctgttcgggaaggacggatatatgctgactgactggcagcgctggaatggcagcagcgtcatcggcccgaatgatccgggagactggtatttcctcgacaatacggtggatgggccgttggagggggcatgctggcacacgctggacaacggagcacaggtgatctggtttgtggattagcagacgtaccgatttattatattgattcaattttacggctgacaaaagcggaggcgctgcaaaaccggtttattccagttctgcagcgcctccgcttttgtcagccggctgctcctactgtataagataaacttccgccatctgcgaaccaaactggcgtgtctgggcatgggtgtcaaagaaaatatccacatgtctgccctttacgccgccgccgacatcctctgccgtgtaaacggttccgttaatcatcagtctgcttccgatggggataaccctgggatccacagccaccgtatgcccggccgcggcgattgctccggaactggtatggcgtccccatccctcggaacaggaacggcaggggcagtaggcggtaagacggaaggtgccgagaaggtgggccgtccttccgtctgtggctgcggccgcgttcccttttgtatagtagacggagttagtgaacttctgtccgtctttgtaagctgccgccgaatacgttccgtcggctaaattgctcagatcaacggtcgcggtaaaagccggggttccttcttctcccacctgtgaaaccaggtcatttcttttggaatccggtttggcaggtatttcacttaccgtttcgccggtcacggtgttcgtgattttcaaaagaatatcgggagaggagagcggggaaaccgtctcataggcccagccggaaatctgcgttccgttgaaaacgtcaacgctcccgacgatggcgcctgctgaggcaaaagccggtgttgtatagaggaatgtgagacttatcatcagtaagagatactttagaataaacgtttttttcataatagataaacgctcctttctgttaccttacttacaataattacatatcgtaacataatttaacaaatatgtaacaattaggtaacagtattgtattatacatgatttccagattttgtcaagttcaaaaaaaacagacgctatgacaagattatcatttgtcatagcgtctgtttctttgaaaggaccggcgtcaaaaaatctgagagccgtgtctgtctttactccaccgcgtatacatcaactgttttcagaccgtaattaagcgcctgctgatgtgtgtcgaaaaagatgtccaacttattgtcgactacattcgttccgatgtcctctaccgtataaatggtgtcgcctatcattaattgagtgccgatagggaagcggtttatatccgccgaaatggtgtggttagctgtagggacggttcctgaataggtcagcttatggccgcccggacaacactgggaacagttacaatatgcagttgtctggaatttaccgagataagctcccttctttccagtttccggtgaggccggtaccggagcgcttttgtctccggcaggtccctgtgacgctgccttcacgccggccgtctccttcttactgtattggggagagccgtaaatccggttctttccggaagccgtctcaacatatccctccacgataaaggatgtgccttcaaggctgtcccaattcacagtgtaagaaaaggcgtgattgccgtttcccatgctatttgctaaatcactacggtattggtctgctgtcactctggcaagttcctttgcctcggtagttccgtctgtgtaaacatagaggactacggaagcacttttgtcaggattgtccgtatcaactgcccatccgcttatgacggaaccggtaatcgggtccatctcgccgtttgaattgtcggcgaaggatgtaaacacacccatcagcatacaaatgatggtcagagctgctacggcaaatccatggcgtaagcttgttctcatgattttcctcgcaatccggttttattttgttttggcaatggaaagcccgtttgacgcgcaatccatcatgtttcataaatattatgatgtattatcattatattacaaaattattaaaagtcaagataaacagcggaaacgccccgtatgggcagtgcaaaaaacgcttataaaacgttgcttttcaccaattccggagaacaagctatagatgaaaacaggtccgatggatacttcatattgtggaaaaaactggaaaaccaattcaaattttattaagaaaaatatttttctaaaaatttctaaaaaattagaaaaacgggttgacaaaaggaaggtgaagtaatatagtatcaatgtagatgttagcactctcaaaggttgagtgctaataaattaaaaacttccttccgggaagatggatactgagaaaggatgaatgcagatggaactggatgagaggaaagaaaagatattaaaagcgataatccagacctatctggaaacgggggagccggtcggctccaggacgatttccaagtattccgacctgcagcttagctcagcgaccatacgcaatgagatgtccgacctggaggagctgggttatattatacagccccatacctcggcgggacggattccttccgataagggataccgattctatgtggatcagttgatgaaggaaaaagagaatgaagtcactgagatgcaggaactggtgattcaacgggtggacagggtggaactgctgttaaagcagcttgccaagcttttggccgtcaacacgaattatgcaacaatgataagcggtccccaatatcatcacacgaaactgaaatttatccagctttccagggtagaggcagggaaacttttaatagtgacggttctggagggcaatattatcaagaactcaattgtccgcctggacgcagagctgaatgatgatgagatcctgaatttgaacatacttttaaacaacagcctgaacggcctgacaattgagcagatcaatctggatgtaatcagcaatatgaaggaacaggccggcgacagacgccaggttgtggacctggtgctgaatgaagtggctgaggcaatcagggccaatgaagaggacctgcagatatatacggaaggaactacgaatattttcaagtatccggaactgagcgacggccagaaggccagccagctaataagcactctggaacagaaggagcttcttaaaaatctctttacggaatccggggagggaagcgaaaagcatgaaatacaggtgtatatcggcaatgagaccccggttcagtccatgcaggactgcagcgtcgtaacggccaattacgtattgggagacggtctgcgcggaaccattggaattataggtcctaagcgtatggactacgaaaaagtggtatctacccttcgatcgctgatgagccagctggaagatacttttaaaaatgaagaaaggtgagttgcaaagtgagcgaagagatgaaagatatagagatgaatgatatagaattgaatgaatccgcagctgcggaagaaacaaacggcatggcagccgatgaagcggcaaaaaccgaagagacatcggcgcagggaaacaatgaggcgtcagaagaggcggacggtgaagcttccgagacgggcgcaaaagaaaagaataccgagaaaaagggggtcttttccaaaaagaaagataagaaggatgagcagattgaagaactgacagaccgtctgaagcgcacgatggcggaatttgacaatttccgtaagagaacggagaaggaaaaagcggccatgtatgaaatcggggcaaaggatatcgtggaacggatccttccggttgtggataactttgagagagggcttgcagccattcctgaagcagaggtgaaatcggcttttgcagaaggcatggatatgatatataagcaattattaaaaacgttagaagaggcaggggtaaagccaatcgaggcagtaggccagccgttcgacccgaatttccacaatgcggtgatgcatgtggatgatgaaacacttggggagaatgtgattgccgaagaattccagaagggatatctctaccgtgacagcgtagtaaggcacagcatggtaaaagtggcgaactaggcagcagaaaagacagttttaagataacagagacaacaacacaaatttagaaatttggtaaacaattaattcaggaggaaaaaactatgagcaagattatcggtattgacttaggtacaacaaatagctgtgtggcagttatggaaggcggtaaaccagtagttatcgccaatacagaaggcgtaagaacaacaccgtccgtagtggcatttacaaaaacaggagagaggctggtaggtgagcctgctaaacgtcaggcagttaccaacgcggagaagaccatctcctctatcaagagacatgtaggtacagactataaggtttcaatcgacgacaagaaatatactccacaggaaatttccgctatgattcttcagaaactgaaagcagacgcagaaagctatctgggagaaaaagtaacggaggccgttatcacggttccggcctactttaacgatgctcagcgtcaggctacgaaagatgccggaagaattgcaggactggatgtaaaacgtatcatcaacgagccgacggcggcagcgctggcctacggtcttgacaatgaaaaagagcagaagattatggtatatgatctgggcggcggtacgttcgatgtatccatcatcgagatcggcgacggcgtaattgaagttctcgctaccaacggcgatacacgtctgggcggtgacgactttgataacagagtgacacagtggctgattgatgaattcaagaaagcagaaggcgtagatctttccgctgacaagatggcacttcagaggctgaaagaagcggctgagaaggcgaaaaaagagctttcttccgcaaccacaaccaatatcaaccttccgttcatcaccgctacgagcgaaggtccgaagcatctggacatgaacctgacaagagcaaaatttgatgaactgacaagagacttaatcgagagaacagcaatcccggtacagaacgcattaaaggatgccggaatcacagcgtccgagcttggtaaagtccttctggtgggcggttccacacgtatgctgtccgcacaggagaaagtaaaacagctgacaggccatgagccgagcaagtccttaaacccggatgagtgtgttgccatcggtgcggctatccagggcggtaagctggcaggcgatgcaggtgcaggagatatccttcttctggatgtaactccgctttccctctctattgagaccatgggcggcgtagctacaagactgattgagagaaatacgacaattcctacaaagaagagccagattttctccactgcggccgataaccagacagcggttgacattcatgtagtacagggtgagagacagtttgcaaaagacaacaagacattgggcaatttccgtctggatggcatccttcctgcaagaagaggcgttcctcagatcgaagttacctttgatatcgatgccaacggtattgtaaacgtgtctgccaaggatctgggaacaggaaaagagcagcacatcacaatcacatccggttccaacatgtccgattccgatattgataaagcggtaaaagaagcggcggaatacgaagcacaggataagaagagaaaagaagcgattgacacgagaaatgatgcagattccatcgtattccagactgagaaggcactggaggaagtcggcgacaagatcgatgcaaacgataaggccgttgtcgaggcagacttaaatgccctgaaagaggcaatcaacaaagctccgattgatcagatgacggatgcccaggttgatgagattaaagccggtaaggaaaaactgatggcaagcgcgcaggctctgttcgcaaaggtttacgaagcggcacagggagcggcaggcgcacagggaggtcctcagccgggcccggatatgggcgcaggcgcacctcatgatgacaatgtagttgacggagacttcaaagaagtgtaatatagcttctgacagtgattaagataaaaaacacgtaacggggattgggcaaagcccaagcccctttacgggtgtttaggagaggaagacttgacatggcagagagtaagagagattactatgaagtcttaggcgtttccagggatgctgacgacgcagcccttaaaaaagcatacagagcacttgctaaaaaatatcatcctgacgcaaatccaggcgatcaggctgcggcagataagttcaaggaagcttcggaagcctacagcgtattaagcgatccggaaaagagaagacagtatgatcagtttggtcatgcggcctttgacggtgcggcaggcggcgccggaggattcggcggctttgatttcagcggcgcggatatgggcgatattttcggcgacattttcggtgatttgttcggcggaggaagaagcagcagaagcgcaagcaatgggccgatgcggggcgccaacgtgcgtaccagcgtgcgtatcacatttgaagaggcgattttcggctgcgagaaggaacttgatctgaacctgaaggaagtctgtgataaatgtcacggaaccggtgcaaaaccgggaacccagccacaaacctgtacaaaatgtaacggcaaaggaaaaattatgtatacgcagcagtccttcttcggccagatccagaatgttcagacctgtccggactgcggcggtaccggcaagattatcaaagaaaaatgtccggactgctatggaaccggttttgtcaccaggagaaagaaaatcaaggttacaattccggccggtatcgataatggccagagcctgcgcgacaggggcaacggtgagccgggtatcaatggaggcgaaaggggcgatctgcttgtagaagtaatcgtatccccgcatccgatattcaaacgccaggatacgagcatctattccaccgtaccgatctccttcgccaaagcggcgctgggcggcccgatccgtatcaagacagtggatggggaagtggagtatgaggtaaaagcaggtacgcagaccgacacgaaagtgcgtctcaaaggaaaaggcgttccgtcgcttaggaaccggaatatcaggggcgatcatttcgtgactctggttgtacaggttccggagcgtttgaacgaggctcagaaggaggcgttaaggcgctttgatgatgcgatgaacggtgtggctccggatggggagaagcctaagaaaaaaggattgtttaaataaacgggtgagaacgctgccggtacggccggcggacgggatggtggggtgtgtatatgagtctttcgtcccgggggaagattgtcgtggtatgggactgcgggcgaagattaaagtctgcggagcccactcacgctctgtgaaatgcatcgcgctgttaagctcgagaggacctcgcaaatcagcaatggattcaggcggcatccgcagacttaatcttcccctccgccccaaggccatgttatcgccgggacgaaagacttaaggccaagggtatcgcccgtccgccggcctgcggccgctgaatgtctcacgcgttaagtgcgggagactgtctgaaaaccaggagtgattagacgcatttgaagctggctgcgcagcatccgcttcgaaaaattcaacctattgataattgtataaagcatgcatttataaagactttccgctctgttcatagtataatacgtataaaaatatataggatggtgatcaaatgccttatattcgtacggtagatcgggagcagttgatgatgtgttcgctggattcttttgtagcacctgagagtatcgcaagagtgattgatgcttttgttgaagggctggaaccccaaaaaataggaattgcaaaaagaaaagccgctattgaggggaggccgtcctatccctggcgatgcatgataaagctgtatctttatgggagccggaagaaaatccgatcctcccggaacctggccgaggcatgcaggcttaatgtagaggtgaaatggctgatggagggattggagccggatttcagaaccatttccgatttccgtaaagaaaacatcgactgcatgaaaaaaatatttcatgagtttaacaggcggatttcaaaatttctggaaaagggatttgtgtccgtggatggaagtaaatttcaggcagtgaattccaaggataataactttaccgccaataagttggatgaccggattcgctggttgaaccagcacacggatgaatatctgcgccagcttgccgaactggatgaaaaagaagaccaggaagagccgtcgggccaactgacccgggaggaactggagaaaagactgaaggaggctcacaaccgcctggaatattaccagcggtaccgtgcttatatggaagaaaacggcttatcccagctctctctgaccgatccggatgcaaggcttatgaaaagtaaaaacggttttcaggtagcttacaatgtccagaccgcggtcgattccgaaacacatttaatcgaagattatattgtaaccaatcagatcacagaccatggactgcttggagcaacggtatgcgcaataaaagaagcggcagccggagccgtcgtggaggcagtggcagataaaggataccatgaagtaaacgatatggcggactgcctggaaaaagggattataccaaatgtaatccttccgtccggtcaggatacctatgagctggagatccggtatgaagaggccggggaagagccggatacggaggccggagcggaagggataaagagaagcctgcggtcagggaacatcccgaaagaatacgaaggaatcatagaaaaggcagccatagtagaaaaaaaggtgtttgtaaaagaagcgggcattgaaccagccggcgccctctatgacaacggggaagaaatgaaaaagcatgcacaggaaggctattttgtgagagaccggaagagaaatcttgtatactgtccggcgggagaaatcctgaggcagaaatgtgtcaagagaaacgggaccatccggtatgcaaacaagagtgcctgtaagcactgtaagaaacggaacgggtgttataaagggaaaaacgaggggaaagaaatcgattttagcaaagatacacgtgaaaagccctgtcaggattggctgaaatcagatgggaaggatgcggagaaagagaagcaggtaaaaaccggccattatgagcttaaaaaagtggtgaggataacatttcgtccggacaggaaaaaaatgagccagcgaaaaaatctgtcagagcatccatttggaacgataaagagatggatggacgcaggctactatctgctccgagggaagcagaaggtagccggtgaaactgcgctcatgtgtctgggatataacctggagagagcaaagaatctgttgggatttgccagattaatggaagccatgacataaaacgaaggtgttttattaaaaatgataggaaaggaccaggacccttttcaatgtaaaacataaaaatctaataaaataaaataaaaaacgtgttttcggacggtctggcggggggcggaccttgtcgaggccactcaacgcatccatatgtgtttgatatatgcaggctatgggataaagtatttgttagagtatgtttgttagaagtttaatacatttgatgtggttgaaggcggtgacctgtgcgcggagcgtgcaggttattttaattggagatttagttaagcaggtgaggacgccgccggtacggccagcggacggggtggtgggtggtgtatatgagtctttcgtcccgggggaagattgtcgtggtatggggctgcgggcgaagataaagtctgcggagcacgctcccgctctgtgaaatgcatcacgctgctaagctcgacaggacctcgctaatcagcgatggatttcaacggcatccgcagacttaatcttcccctccgccccaaagccatgttttcgccgggacgaaagactccgccgggtgtatcggccccgtccgctggcctgcggccgctgatagtctcacgcgttaagtgcgggggcggaccttgtcgaggccactcagcgcttccgtgtgcgggaaatacgataagccttcaatgcgcctttattaaaaaatagtggaagatttgatatcagccagtcggaaatacgtagtggccgcgacagggtcctccccatttaaggttggagacaatcagcggccggaacggaccatgtccggtgccgcgaaaacctccgcctgagtcttccgtcccaggcgataacctgcccaggggaagtaggcggaatcaattgcgaaggggacatgggagtccgccggtgcttggcgaggtcctttacgagcttagcactgttgcgcactccaaagagtgcaaacggtccccgcagcaattcattccggccggattccccctccacaaccaacttcccacggggacggaagactcagccatcccctcaccacaccggacatggtccgttccggacgcgtcctccaacctcagttaaatctccatactgcttaataaaaaggtaaactttcgtaagttgacttaccccgaaatgttctatacaattagacaatggctgacaccgtcaaaaatttcagaaatggtaaagaagcagagagggagaaaaggtcagatggcagatattaagaagaccgcggatggcgtggacaatgacagcccatacagggctttggaggctgacgcggcacagatgaaaatagaagaagcccagggagagctggagccgggggaggctatgacggagtgtgaaatggaagtcgaagccgatatgctgctccaggcagctctggaagagaaactgaaggctgaggcaaggctggaggcagccctggaagagaaacgggcggctgaggcaaagctccaggcggctctggatgagaaccgggaggctgaagcaagattggaaggcgccgctgttatcaggccggaggctgctgcttcggagccggagcatggcgcgccggagtttgccggcacatacagggaatctgctgaattggaacaggaagccgcaggttcggatgaagctgacgagccggagcgcaagatggccggtcaggaacgggagcttcacgaaactgagccggagattgataagctggagccggtttgggaaaacagtgctgcaaacggcagtgacagcggcgagacataccgggaggagcgcgccggaagaggccggagccgcgccagaagaagcagaaagaaaaatgcggggcagggaatagagatgccggagggagtccatgattcccaaaacaatcatgaaaagacggcgttccccgcaggacagacggaagctgcggcagctctgcaggaaggcaggggcaataagaaccaaaaaggcaaaaaggcggctattattgcagcctgcgttctggcagccgttattgtggccggtggaggagcttacgcagccatggcacagaaatacaagaaggtatttttcccgaatacaatcatcaacggtatgaacgcttcggggcgtacggtggctgaagtcaaagagatgattgcaggcggtatcgagaattacgtcctgacaatcgaagagcgggagggaggacaggagcagctcacaggtgaggatattaagcttaaggccaaattcgacggctcgctggagcagattgtcacaacccagaatccgtatgcatggctgagctaccagcttaatccggccgaatatacaatcggcacaatgattgaatacgatgaggaagcttttacagatgcagtgaaggggcttaaatgcatggatacggctctgatgaaggagccggaaaatgccggcatttccgattatgttccgggccagggctaccatattgtacctgaaactgcgggaacatatgtaagtgaagacgtcttaagaagcagcattacagatgccgtcatgaatttgaaagatacactgtcgctggaagaagcaggagcgtataagcagccggagattacacaagatgatgcagccctgaaggagcgtctcgaaaccatgaaccggtatgtctccacaacggttacatataaattcggagataagtcggaggttttaaatggcgacaggacacatgagtggctggtaacggatgaatccggcggcgtatcaatcgatacggcgcgggcggccggatatgtggaggagcttgccgctgcctacaatacttccaacaaggcaaagaattttaaaacctcctatgggcagacaatccaggtaaagggaggcacttacggctggaagataaatcagaaggaggagacggctgagctgatcgccatactcaagtccggccagagccaggagagggaaccggtatattcccagaaggcggcaagccatggggagaacgattacggagatacctacgtggagatcaatttgacggcccagcatctgttcttctataaaaacggaagcctggtggtggaatcagattttgtgtcaggcaacctctcaaagggctggggaactcctgccggaacatatccgcttacctataagcagagaaatgccgtattgaaaggagaaggttacagaactccggttgactactggatgccgtttaacggcggaattggtatgcacgatgcaacgtggagaagttcctttggcggaacgatttataaaacgggcggttctcacggctgcatcaatctgccccacagtgtggcaaagaaaatttatgaaaatattcaggccggaatgcctgtaatctgttacaacctggctggaacggagaagggaacctctgcaacaccaccgccggctcaggtcccggccgaggtgccgacacaggctccggccgaggtgccgacgcaggccccggccgtgcctgagacacaggctccggctccgcctgagacgacagccccggcaggccccggttctgatacggggcatggtggaggcgcctctggcccaggctccgaaatcagatagaatacggatttaacggctgcggtttccgctgaaagagagggctgtgaaccgcagtcacttcacacaatataattactataagataaagaaggtcagaagatatggaaaataaaaaatacagagtggctgcggcgctgataactgccgcagtgctgacagccgtttcaggctgcagcagtccgggaacttcaggaggggcgcagacggaggccgaaagcactgcagcaggaaacagccttcctgaagcagaaaagcatcaggaagcggacgaagtgccggaagagaagaggaaacttctggaaaccatgacggcagcgattgaaagccagtttcctcaggagacttttaccgatataccgatagatgagacagaggaggccgtttccaaattcaaggaaagctacgcattatccggcagaagatcatcattgggcaaagaatatatagccggcgtgagcctcagggatgaaaacccgctggagggaatgaactgccggagtgacgggaaaccttcggagtatgtcaccagccagtttgcagacggccgttttattctgatggagaaagcaggcggggaaggcggcggtttttctgagctgtatgacatactacagacgggagagagcggactttcatatatgctggatgtggcacagcgccaaaataccctcgttatgccggaagaaacaccgtttgtacgtgtatatatggtaaaagggccggttcccgccgcggaatatattccattgacacaggaggaatataccgtcataaaggaaggaaaacctgcagaaatgcaggacggtactgcgggaacgctgctgctgtgcgaacggaaagaggatgtgcagaagctgtggactgattcggccccggccgttacggaagagacactccgtctggcgcaggaacgctgcggatacagcgcagacgcgctgagtcaggagcctgtagtcaaggcatctatgacgcttcgggcgcatggggagacgcgggaagaaacgctgggcaaccgggaggatattgaccgtctgcaggaaattctccagaaaatcacaccgcaaactgatttcctctccagcccggcggggagctatgacgggactattacgcttaccggacaggataatactgtgcagacactgcatatcggactgcagggaggagcctgtgttctggggacatcatggttcggcatgctgccggaagatgatgccgcagaagtcttaaagctgttcagcacgatagacggctggaaccggtacggcggtgaaatttcgatccggattgatgatgctgcccatactgaggaagatcagtcgattgcctttactttggaaaatgggacgggaggtcctatcgattatattctttccccgattttctataaaaaagagggcgattcctgggttatgctggagagtattgccggattctgcggtgtcagcgaccgaatggaggaagaagaaaaggaattgtcggttccgtggaagggagcatttgagacaaggggagaaggactttataagctggaaattcaggtagccccggaggaaggactccgctttgcagtctctgatacatttgtcgtaaaaaaatagtttacattaaaaaaagattgtgctatactgagtcggtatgaaatacgccgatgcccggttttttgaggactcctgacataagcctggcacctggtgagaatattaatttaaaggaggaaatcgcaatgatttcaaaggaaaagaaagctgccattatcgcagaatacggaagaaaacctggagacacaggttcaccggaagttcagatcgctattttaacagcaagaattactgagctgacagagcatttaaaagaaaacaagaaggatcaccactccagacgcggacttttaaagatggttggtcagagacgtggacttcttgactacttaaagaagacagatctggaaggataccgtactttaattgaaaagttaggcatcagaaagtaataacaagatttagggtggagcaatccaccctagttgtttatggtggcggaacgtatgaggacatacgtttctctgcttatgtagaagatctaatccgagaccgctgatgtgcatataaggggaatgccttgtgttcagatcagtagtttcggtatcttctgcagaacaataggaaatgatttatttttgaaaggagatacgaaatgtataagagtttttcaatggaattaggaggcaggacactgactgtcgatatcggcagagtggctgcacaggcaaatggtgcggcgtttatgcattatggagacaccacggttttatctacggcgacagcatccgacaagccgagggacggaattgatttcttcccgctgagcgttgagtttgaggagaaattatatgccgtaggcaaaatcccgggaggttttaacaaacgtgaaggcaaggcatccgagaatgcagttctgacatgccgtgtaattgaccgcccgatgcgtcctcttttccctaaggattatagaaatgacgtgacgctgaacaacctggttctctccgtagatccggactgcagccctgaatatacggccatgctcggcgcagcgattgcgacctgcatctcagacatcccctttgacggtccctgtgcgacaacacagatcggactgattgacggagagtttattgtaaaccctaccaacctgcagaagaagctttctgatttggctctcaccgtggcttccacaagagagaaggtaatcatgatagaagcaggagccaatgaggttccggaagatatcgtgcttcaggcgatctttaaggcccatgacattaaccaggaaattattaaatttatcgatacaattgtagctgagtgcggcaagccaaagcacacatacgagagctgtgccgttccggaagagctttttgcagcaatcaaagagattgttcctccggcagagatggaagaggccgtattcacggacgagaagcagaaacgtgaagagaatatcaaggctatcacagcccgtcttgaagaggcgtttgcagacaatgaggaatggcttgcagtactgggtgaagcagtataccagtatcagaagaagacagtccgcaagatgattctgaaggatcataagcgtcccgacggccgcggcgttacagagatccgccgtctggcagcagagatcgatatgcttccgagagttcacggttccggtatgttcacacgaggacagacccagattttaaatatctgtacactggctcctctctccgaagcacagaagctcgacggacttgatgaaaatgaaaaatccaagagatatatgcaccactataacttcccgtcctactccgtaggtgagacaagaccgtccagaggaccgggacgccgtgaaatcggccatggcgccctggcagagagagcattaattccggtacttccaagtgaagaggaattcccatatgcaatccgtaccgtgtctgagaccatggaatccaacggttccacatcacaggccagtatctgtgcctccactctgtccttgatggcggcaggtgttccgattaaggcaccggtagcaggtatttcctgcggccttgtaactggtgatacggatgacgactatattgttttgaccgatatccagggccttgaagacttcttcggcgacatggatttcaaggtgggcggaacccataagggtatcaccgcaattcagatggacatcaagatccacggccttacaagaccgattatcgaggaggcaattgccaagacgagagaagcaagaattcacatccttgacgatgtaatgaaaccagttattgcagagccgagaaaagaacttagcaaatatgcgccgaagatcgagcagattacgattgacccgcagaagattggcgatgttgtcggcaagcagggcaaggtgatcaataagattattgagcagaccggtgtgaagattgacattgatgatacgggaacagttgccgtatgcggtaccgataaagagatgattgacaaagcgcttcatattatcaagagcattgtcacagacatcgagccgggccaggttatgacaggaaccgtcgtacgaattatgaatttcggtgctttcgtagagctggctccgaataaagacggtatggttcacatttccaagctgtccgataagagagtcggaaaagtggaagacgttgtaaacattggagacgaggtcactgtaaaggtgattgaggttgacaagatgggaagaatcaacctgagcatgaagccgggtgatctgaacccaaaggctgagaaaaaagaagatagagcggaataatccgctgaaataggggctgctgcagaacggatatacggaaggttttgcagcagcccctgctttcgcagcacgcttgtcatcgttccttgcaaaaacagaacagactgctgctgttagcagaccgcgttgttcagcgggctgtcgatagtaacaacagacttgatatgggagaataatttatgctggaagtaaagggaatttcgaaacattataaaaataagcagatactgaatggcatttcttttgccgcggggccgggacagtgtgtcgggatcgcgggcggcaacggctgcggtaaaacgacgcttctttctattctggccggtgtaaacaggccggacaggggaagcatctgctttgatggagtggaggcagtgggaaacagaaaggtatttgagagaaatgccgcctatgtgcctcaggaaaatcctctgataccggagctgacggcccgtgataattacaggctgtggtttaagggagataaagcggagctggaacgggatctggaagaaggtgttggaaaattcctggggcttacggaatttctcgggacaccggcaggaaaattgtcgggcgggcagaaaaaaagactcagcatcgcatcggccctttcgaaccaggcttcccttctgattatggatgaaccgggagccgctcttgatctggaagccaaagaagagattcttacgtatatcagaaattatctgaagaatgggggaacggtgattcttacttcccacgagacgcaggaactgtccatctgcacgcagctttttgttatgaaaaagggtctgctcatgccggtgacggagaaactgtcggctgcggagctggttttacttttttaaatcttaagattatagacaaaatcttacaatatctgtattaatgatggttctttcacaaagatatgttatactaaatgcgttaattatttgcataaatttgataatggaggaaaaaggatatgaaatgcccgcattgcaatcaagaaatcaatgatgaaagccaaatttgtacatattgtggaaaatcattgaacgaagtaccggacggccagtctcagacggagaatcaggagcattcttccgatacagaggcagacagccaggcaacagcagagccggcggctgaagagaatatagtggcgccggaagcaggagctgaggttacggaagcaggagctgcaaaagaaactacggagccggcaggcgaaccggcagaaccggcaggcgaagcgccgaaaggaaagaagaaatgggtaatacccgcagcgattgcagcagtcgttgccatcgcggccggagcatttgccatgacaagcgcaaaggatccgaaggatgccgtaattggagcatttaagagcattgtagctgagggacagacaaacccggcggaagaaattttcggagtcagcgccatgacggataagctgaataaagagtccagcgagatgaatatggaactgacggtggaaggttcctccgacgaaacactcagccagcttgtatcaggcaagataggcatgtccgccttaaatgacattgacaacaaaaagatgagttttgtgatgggtgtcggctatgcagatatgaaccttgccaactttgaattctatctggatgaaaaagaactggtcatggcgattccggaactgtcatcaaaggcgttctcaatgaattatgccgatgatctggaaggtcaggttaagaattcaccgtatctggggcagattctccaggacagcggaatggatctcacaggcctgaacagctaccttgaaaagtgcaacgaactggcggcaggcggagagcagtttttcgacctggaagaactgtggaaacgttataaagaaggcagcaaggctattgacgatctgaaagcggccatgaccgtggagaaagcggaaaagaagagctttactattgacggcaaagaagtaagctgcgacggataccatacgactatcacaaaagatgccctgattcagtttgcgacaacaaccaaagaattcttcctgagtgacgagacgctgaaaaaagattttatcgaatatatggatttgatgaacgaacttcagggaaccatggtaatgatggcaaatccatatgcccagaccggagaagagatgcagcaggagctgtggaaagaagctgaaacgcagcttgatgcggtaattgaagaattaaaagattccatgggtgatctgacgatggacgtatacgtaaggaaggacggcaaaatggccggcttcgattacgagacaactgctgtgatcgcagaagaaaatatcaagctctacggtaatgtcgcatttgccggaggctacagcatgatgtccaacgtgaaagcagttttaaatgttgagtctgctgacggcgaagtagtgacggcttctgtcgataagactggtacctacgagaaagacaaaacatgggccgggactctgagaggaacaatcggaaacggaacggattcttacagcttcgtttataccggtgattataacgcagagagcaaggattacaatctttccctcgatctcttaagcggggaagagagccagtttaccatcagctcaagcggtatgtttaccgatcttgtaaaaggagaatcctttaaccttgagatgacctcccttaagatggaaacacctctgattaccggagagaacgagtaccttgaactgtccggcaaatatcttgccggtccgctgaatcagacagtggaagcgccggaaggtgacagattagatcttcttgccgctacggaagaagattataataatgtatatactgaaattatgggtaatgcattcagtctgatgatgaaattctattaatgagataaagggatctgtatgcgtacattcttgacatattttaaacttgaactaaaaaggacgttaaaaagtatcccatattttcttgcaggagcaattgtgctggtgttactggctggcacaattgctttttctgcaagtaagatgctttatggagacaaagcgcttgggaaaattattgtaggtgtggtagtgcctgagaatgacaggctgtcggagatggctatgaatatggtggcttctctggacagcgtggggagtctgtgcgaatttacctatacggataaggaggaggggacgaaactgctggagcgcggagagatatttgctctgatggagcttccgccgggtcttctggagggaatcatcgacggcagcaatatccctgtcacaatcacatttcctgaaaattcaggactggaagccgcagtgtttaaggaactgacacaagccggaacctcgattctcgggacagcccaggcagccatctacagcaccgacgattatctgataggacatcagatgcaaagctcaatcaggcaggcagagaaagatttgaatacggtattcatgcgttatgccctgtcacgagaagcttatttcagaacagagaaggtcagtgcgtcaggcgacgtgacgacagccgtattctatgggatatcggctgtcgtcatgattctgctgcttcttggaatccctgcggcccctatcgtgcgcccctataaaattgtggtggagcaaaagcttgccctctgcggaatcggaagagtaaaaagaacagccgtgaggacggctgcgctcaccacgctgctgcttctggcttccgctgttccgcttgcctgttttatcagtaaaggttattttgacagtgcgtttactgcggtggcaggctggctgcttgtatgcatggcggctgctggctggattttgtttatctacgagctttgcggcaatacgacggcggcaatcctgcttttatttgtttccacgatagtgatgctttttatatcgggcggaatcataccggctgtatttctgccggaggcagttaccgggcttggaaaatggatgccggcagcttttctgatggatgcggtaaaatggatgataaaaggcggaactgcactgcctgtgttgaaacttgtcttaatggaaggaattgtgtttgctttatcggcagttttgagaaggaaggaatatgattatggataaaattgttttatggttcttcctctcctgcaaaaggcagcttaaaaaaccgttttttttgattcttcttctgattctcccggctggtgtctggatgttccacaaggcggaagaagaaagttcaggaaaaatttccattgcactttatatggacggcgatgaatggaatgagaaggtagcggagacactgtcagaaggagaacattcatttgaattctatcagtgtgaaacgcttcaggagcttcaggatgacgttgcaggagaaaaggcggaatgcgggtattattttcctgccggtttcagggaactgcttaaggagggcggataccggcgctcggtaaagctgtatgtctctccttcaactgtagcggacaagctttcctccgaagttgtgtttgccggtttctttcaggtattcggcagagaacttcttgaggaatacacccggaccgggcagccttttgaggaggccagggcaggtggacggaccggcatggagccggaacaaatctgggaagagctggagcctctttatgatcagtatctggaaaacggaagtacttttgcctttgaatacaggactatgggggctggagtactgaaaaaggattcggtgacggccgtattcccggtcagaggcatctgcgccgtattcatctttgtcatgggacttgccgccgccgtaacggccggtgaggatgaatcgagaggactttattgtgcagtaacggcgggcagaaagagaagctatctgcttgcacagcttgcggcgcctgttcttttgtcctgcgtttccgcttttatctgccttaccatttccggtaacctccgggggattgggagggagtgggcggcgctgcttgtatacggcctgatgacgctgcttttttcttatattctgcttatgacggtaagaagtcctctggtgatttcggggctgattcccttctttatactgggaagcctgatcatctgccccgtgtttgccgatttatcggtttttgtaccggttctcggggtattgcggcggtttttcctgctttattattacctgattatgtagagatggaattgagaatggaggacgcgtccggaacggaccgggtccggtgtggtgagattggtttttctgagtcttccgttcccggttcaggttttcgccggggacggaagactcaaggcgaagattttcgccccggccccggcctgttccggacgctgattgtctccagtttcaatggcggaggggaccttgtcgctgccccggctcacaacaatcctcccccggaacaaaagactcataaaaccaccccgccaccccgtccgctggctgtcccggcggcgtcctcacctgcttaattaaatccccatcatacaaagattttacaggaaaaaatgttgctatttttcagttaaatctatataatgagaaaggacattggttagtgtaaaaatttcgttataaaatggaaaggagtgaacacaatggaaggccgaagtcacaagacggaatcagatggcagccaccctgaaccgaaggcagagcgtacttcgattttttgttgtgtgcactgccgttcttaagcagcggtgaagggcgcgcccaggcgtgcgtttcgtcgcaaggttgttttttctgtttccaaaatatataaaaagaaattttggaaggggaagatcatgttggatgaagagatcaaaattgaagataagatagaagaattgctgaggatgactgccgataagaggtacagggagctgaagctccagctggtggagatgaatgaggtggatatcgcttccttcattgaggagctggactcggagaagacggtggttgtcttcaggatgatgcccaaggaactggcgacagaagttttcgcctgtctgcccgttgaaaagcagcagcatattattacaagtattacagactatgagcttcgcagcatcattgacgatctgtatgtggatgatgcggtggatatgctggaggaacttccggccagcattgtgaagcgtgtgcttcagaattcaagtcccgacaccagaaagctgattaaccagtttttgaactatccggagaacagcgccggaagcgttatgacggcagaatatgtcgggcttaaaaagcaaatgactgtggaagaggcatttgcctatataaggaaatacggtgtggataaggaaacgatctatacctgctatgtaatggatgaaaagagaaggctggaaggtgttgtcacggtaaaggacctgctgatgaatccctatgatacggtgctgggagacattatggatgtccatgtgattaaggcctacacgacggaggatagggaggaagttgtagatacgttcaacgagtacagcctgctcagccttccggtggtggataaggaaaaccgtctggtgggaattatcacggttgacgacgtgatggatgtcatggaacaggaggctaccgaggatttcgagaagatggccgccatgctcccgagtgagaagccgtatcttaaaacgagcgtatttcaattggcgaagaaccgtcttccctggctgatgatcctgatggtcagcagcatggtaaccggaggaatcctcctgaaatacgaaaatgcgtttgcagccattccgctgctggttacgtttgttcccatgctgatggatacgggcggaaattccggcagccaggccagcacgatgattatccgcggtatggcggtcggtgaagtcgaaccgtccgatattatgaaggtggtatggaaagaactgcgggtgggggtgctctgcggcgtgggcctggcccttgtcaatttcattcgtctgatgctccagtatcccggccagcttatgatctgcctgacggttgtcatgagtatattctttacggtaattattgcaaaaacgataggctgtactctgccgattttggcgaaagtcatccatttggatccggctatcatggcggctccgatgattaccacaatcgtggatgcatgcagcctgatgatttatttccagctggcctgccggttgctggggttgttaggttagcgggagatttaattgagcaggtgaggacgccgctggtacggccggcggccggggtggatttataagtctttcgtcccgggggaggattggcgtgagttgggactgcaaagaagatatagtctgcggagcatgttttcactcggtggaatgcatcgcgctgctaagcccgacaggacctcgcaaatcagcgatgaattccaaaggcgtccgcagactatagtagttgtttgagtctatttgttggaaatttgatacattggatgtttaaacagattgagcggaattaaagccggaatattattaccggatttaattccgctcaatttgctgtaattgatggcggtgccctatacgccaagccacccgttttagggatgacgcccccctgaggctggagacaatcagcgtccggagcggaccgggtccggtgccgcgaaaaccttcgcctacttccccctccacgtccaacctcccacagggacggaagactcagccagtcccctcaccacaccggccccggtccgctccggacgcgtcctccattctcaactaaataaatcataaagccccattgaatactaacttgtttttttccagtcttcgttatataatggattttatcaatgattaggagtgtgaaactatgacgaaaatcagaacgagatacgcgcccagcccgaccggcaagatgcacgtaggaaatttgagaactgcattatatgcttatttaattgccaaacacgaggatggagattacattcttcgtattgaagatacagatcaggaacgttttgtcgaaggtgcaacggagattatctataatactctgattgataccggccttaagcatgatgaaggccctgatatcggcggcccggtgggaccgtacgtacagagcgatcgccagaaacaggggatctatatggaatatgccaaagtgctgttggacaagggtgaggcgtattactgtttctgcggacaggaaaggctgaacagcctgaagagaacggtgaacggcgaagagattatgacctatgataaacactgcctgaatctgaccaaagaagaggtggaagcaaacttaaaggcaggtatgccgtttgtcatccgccagaataatccaagcgagggaaaaactacgttccatgatgagatttacggtgacatttcagtagataattcagagctggacgatatggtgctgattaaatcagacggctacccgacttataacttcgcaaacgtggttgatgaccatttacagggaattacccatgttgtccgcggcaatgagtatctttcctcctccccgaaatataaccgtctttacgaggcattcggctgggaagtgccggtctatgtacactgtccgaccatcactaatgaggaacataagaaactgagcaaaagaagcggccattcctcctaccaggacctgattgaacagggatttatttccgaggcggtcgttaactttgtcgccctgctcggatggtcgcctgagaacaatcaggagatattctcactggacgagctggtaaaagagtttaattataaaaacatcagcaaatctccggccgtatttgatatggttaagttaaaatggatgaacggagaatatattaaggccatggacttcgaacgcttctacgagatggctgagccgtatatcaggaaggcagtcactaaggagctggatctgaagaagattgcttccatggtaaaaacgagaattgaagtgctgccggatatcgaaggccatattgatttctttgaggcgcttccggattatgatacggatatgtatatccataagaagatgaagacgacgaaggaatcctccctggaagtgttaaaggagcttcttccggttcttgaagcacaggatgactattcaaatgacgcactttacacggtcctttccggctatgtggccgaaaagggagttaagaccggatttgtgatgtggccgatccgtaccgctgtgtccggcaagcagatgacaccggccggggcgacggagattatggaagttctgggcaaggaggaatccctgaacagaatcagaaaaggaattgagattttgtcggaatcatagtgaagtgaagcagattttcaccgccgaacaatacggaggagtgctggggatttcagcactccttttgagatattttacaggaacaggataaccggatatggaatttggcaggacacaggaacaggcgatacgccacaatgaggggccgatgatgatactggccggccccggctcggggaagaccacggtaattacccagcgaatcaaatatctgacggaaagcttgaatatcaatccggcggacattctggttataacatttaccagggccgcagcagaggagatgaaggagcgctatatccgtcttacagggaacgcttccagagttaccttcggaacgtttcactcgatttttttccggattctgaagctggcataccgttacactgcgcagaacattgtcaggccggaacagcagatgcagtttataagggagctggcaggcaaagaagagcttgaactggaagatgagaatgaatttatttcttctattttgagtgaaatcagctccgtaaaaggggaaatgattgatttgcggcattattattccaggaactgtccggatgagacattcagaagaatctgcagcggatacgaagagcagatgcggcgtttgggcctcatcgactttgacgatatgatggttatgtgccggcagttgttcctggagcgccaggatattctggcggcatggcagagaagataccgttatatcctgattgatgaatttcaggatataaaccgtctgcagtatgagattatacggatgatagcagaaccggagaataatctgtttattgtcggggatgatgaccagtctatctaccggttcaggggcgctaagccggaaattatgctggggtttgaaagagattaccccggcgcggggagaatcctcctcgatgttaattaccgctgcacagaagagattgcaggtccggccatgcgtctgatcgagaataatgaaaaacgcttcagtaagaagatcaggacgaacggtgccagggggaagcagattataaccaggatctggcaggacagctttgaggagaacaacaggattgcggaggagataaaagcatatcaggctgcgggataccgctacggtgatatagcggttctctacaggacgaattccgggccgaggcttttgatggaaaagctgatggaatacaacctcccgttcaaagccagggattccgtccccaatctgtatgaacactggatatcccggaatatacttacctatatcagaattgcccttggaagccgggaacgggcggatttccttcagattatcaaccggccgaagcggtatatcagccgtgacagcttaagaaatccccaggtatccttcaatgaattaagggagtggtatcacgataaagactgggtggcggaccggatagaaaatctggaatatgatttaaaggcagtcagccgcatgtcgcctctggcagcggtgaattacatacgccagggagtgggatacgacggtttcctggaggaatttgcagcgggacgcaggatgaagccggaagagctttttgagactgcggatcagctgaaagaaagcgccgccggatttaagacatttgaagaatggttccgtcacatagaggactatggggaggaactgaaacgccaggcccaggccggattgaaggaaaaaagccaggacgcagtcacactggcgacgatgcacggttcgaagggtctggagtttaagattgtctatatactggatgccaatgagggagtgacgccccatggcaaagcggctctggatgaggatatggaagaagaaagacggctgttttatgtggcgatgacaagggccagggaacgccttcatgtgtacgctgtaaaagaacgttatcataagaaggcggagctttcaagatttgtggaagaatacctttgtaaggagtgaaatcatgggatatatacacatctactgcggtgacggaaaaggtaaaaccacggctgcagtcggcctggccgtcagaatggcgggcagcaatgggcaggctgtgatggtccggtttctgaaaaacgatgattccggtgaagtggattgtctgagacagattaaagggattacggtaataccctgtaaaaaaacgttcggttttacctggcagatgacagaggctgaaaaacgggaagcttcggcttattataaagagctttttgatgaggcggcagacctggctcttttaacggcggagcagggacagacgctctttgtcatggacgaggtatgtgcggccgtcaacagcggactgctgcaaaaggaacaggttcttgcttttctggaccgctgtcccgacagcctggagatagtgatgacagggcgggaaccggcgccggagtttatacagagagccggctatatatcagagctcataaaggtacgccatcccttcgacaaaggggtgccggcaagaaaagggattgaatattaatcgggaggacaaaggatgaagggcgtaagaggcaaaaccccggtcagaatggtgacggcccaggagagggaggctttgagacaggagattgaaggagagcatccgggatatttggatgagaacctgaaactgacgacaattgttaaaacatttacgggtataagagttctttacggactatattatctgcttatcacgctgatatacggtcttcagttcacacaggggatatttacgatattcagcgcatttgtattttatctgtggtactcctggatgctgaaggcagggaaaggcgttgccgtactgatgctggttctcagagggttcagtattgtaaccggaggcgtttcaattcttgggatgtcctactggctaccgtatcctctcgtttttacattgacaacggcgtgcgtaatggaattttgtgaggcgattttctgcatctacatactgtttaacaggaatgcatctacggtgatccgcctgaaccgggattgtgaagcgcgtttggcacgtggtgtttccgcggggacactggaaaagatggcggagtataaaaatccctatacaggagataatgattccggcagcggggaagacaaagacgggaaaaacgattgacgcgtcgctgtccgcagacgaaattcagcggggatatttattttcaatgcctgtaaaaatccggcatactgtggctgggaacgcagtgaatgaaaaatatccttgatttttctcacggcctctgataaagtggagttggaaagttagaaaaaagtaaatatgcaattataattgcctgccgtttggcagaagaaagaggttaagatggaagacaaaaagaatatgactccggaagaaatggacaatcaggaggagatgacggtaacactcaccctggatgatggaaaagagctggagtgtgttgtacttactatctttccggcaggagataaagaatatatcgccctccttccgatggaagatgcgaatgatgagtcggatgagggagaagtatatctttaccgctactcagaagatgagaacggccagccgaatctggaaaacattgaagacgacgatgagtatgagatcgttgccgatgccttcgatgaactgttagacgagcaggagtatgatgaagtagtcggagaagacgaattagacgattaaagtaaacggtaggggtcaccgccttcaatcaaagaaaagctctctctgcattgtgccgagggagcttttcgattaaggaatcccgagagggggattcctttcggagtacatcttgcagacataattttacagacacgctccggggataaagcgggcggcagataagaggggtggttacagtggaactcagacaggaacagaaactaaaacagaccttatcacagaatatgcttcagtctacagaaattcttcagatgggacagctggagcttaaggaatatctggaggatctggcactggaaaatccggtggtggatatggacgagatgcgttccgaaaagtcatcggacgacaaaggggagagtaacgaagattttatcaggaggctggaagagctgcagagcatggacgctcaaaaccgccagtattatcaggacgagcaggatgaggccagccgtttcgaaccggcagagagaccggggatggatttaagggatgccctgatggatcaaatcctgtttatgaagatctcaaaggaagaattccgtattttagaatatatgatattaaatctggacgacaacggctatctgacggaggatctgccgcttctgtgcaaggagcttaagatttcggaagaagacggtgaacggatgcttaaggtactctggaaactggaaccaaagggaacaggggccaggaatctcagggagtgtctgctgatccagctggagggcggcagtgaggtggatgagctggcccgccggatcattgaagactatctggaggaacttggcaggaaccggatggagattattgccaggaagctgaagtgcagtatggatcaggtgctaacggcttccgatcggatacggatgctgaatccgaggccgggaagcggctttgggagcggtaaatatcagaaatatctggttccggacgtgctggtggtcaagacagaaggccgttttcagattataatcaatgatgagacatatccgcagctttccatcaatccgtattatctgaccctgatgaagggggaggattccggggaagcagccggatatattaaaaataaagtgaaacaggcggaatgggtatgccattgtgtggagcagagaaacaggacgctctatctgcttgtgcaggaaattctcaaggctcagattgctttctttgaaggcggcagagggaaactgacggcactgacccagagaagcgtggctgaaaagcttggaatgaatgagtctaccatcagccgcgccgtacgggaaaaatacctccagtgccaatggggcctgttcccgctgcaatttttcttttccaggggaagtatccagacctgtccggcggcagacgcaaaaaatacgccttccgaaaaggcaggcggcgccggtgcggaggcggtaaaggaacagattcggattctggttgcgggcgaagataagaaaaaaccgtacagtgacaggatactggcagaaaaactcggggaagccggattctcgatatcgagaagaaccgttgcaaaatacagggaagcgattggaattgccgatgcatcgggaagaaaggttttcgaacggaaaaacacgctgtgacatgctctgaaaaagggggagggccagcaggttagacctgctggccggagtatgaaaaagtctgtctaaggctcttgccttgttcacttattactatacagcagaaatgtggctaaaatatgtgcgtggaataaaacatttataaaaactattgataaaatctaaagaaaatgtggattaaatagttatagtttaccaatcagaggagaatatatgtcattacaattcattatcggcggctcaggctccggcaagacccgtcgtctgtacaacgatttgatagagcaggcggcagggaatccggacggccgctattttgctatcgtaccggaacagtttaccatgcagacacagaaagatattgtaacgctgcatccctgtcatggcgttatgaatattgacattgtcagttttgaacgtctggcctacaggatatttgaggagctggcggtggagagcctggccgttctcgatgatatgggaaagtctatggtgctgcgcaaggtggcggcaggaaagaaaagggaactgaagctgttcggcagtcatctggacaagataggttttatcggggaactgaaatccatgctgtcggagttttttcagtacggcataacggcggaggttttggaagagcttgtctcggaggcggataaggaaaactggagcgcgatgcttaaacagaagctgaatgatatggtagtgctgcaccgcgcatttaaaaaatatacggaagataagaaatgcattgtgaaggaagaaattctggaaatgctctgccgcgttctcccggattcagagcttatcaggggcagtgtggtgacactggacggttataccggttttacgcccgtacagtaccgccttctggagctgctgcttcagtactgccggagagtagtggtaactattacaatggatccggaagaaaatccgtacagggaaagcggtccttcccatctcttccatatgagcaagcacacggtgtgcaggcttacggatttggccgcacagacgggggctggaagggaagaggatatccttcttttgcaatatccggcttaccggttcaaaaacagcccggagcttcagttcattgaaaaggaactgttccgtttccgcggccgtaaatacgaagaatcgtcaggtgcgccgggcgttgtgctgttccagtccgacacccctttaaaagaggtgcagatgatagccggcgagatagagcgcctcattaagcaggaaaaataccgttaccgtgatattgcggtggtgaccggagcgctggacgactattccagagaaatagtgcgccagtttgagacaaacagaataccggcttttatagattataaaaaaaatattatgggaaatccgatggtggagcttctgcgcgcagcccttgaggtcatgcagaagaatttctcttacgagagcatgttccgctatctgaaaaccgggctggtaacggataagcaggagatgttaagccgtctggaaaattacgctctggccctcggcatccgcagctttaaacggtgggatatggcctgggaggccgtctaccggggagccgagcttatcaatctggaggaactgaatgcattccgggaagagatactcacgcccctgagaccgttaaaagacgtgtttggcagccgtaaatctacggtacgtgagaaaacggaggctctggtgcattttctggaggcgctgcatatcgaagaaaagctgcaggattatgaagcggaattccgggaaacaggagaggtgagccttgagaaggagtacagccaggtatacggccttgttatcacattattcgacaggataacggccctcctgggggatgaggcagttgggaaaaaagaatattcagacattctggacgccggctttgaggagattaaagtgggtcttattccggctgttgtggaccgtgttgtggtgggagatatcacgagaaccaggctgtcccacatcaaggtgctgttttttgcgggagtcaatgacgggattgttccgtctgcgtcaggaagaggcggaatccttaccgaagcagagcgcaggagcctgaaaagccgtcaggtggagctggcgccgactgccagggaggaaggctttttacagagactctatctgtatttggttatgacaaaaccttccgaccgtctgtacctctcctatgcagcttcatcctcagacggaaagagcctgcggccttccgggctgattggccaggtgttaaaaatgtttccggaaaaacgtgtgatgagggccgatgaaaaacagatggctgcctggtctttacctcttggaaaacgccgggttatcgagggactgaaggattacggcagcagcaggcaagacagccggtttatggagctgttcggcttttttttacgttccgaattgtaccgggacgaactcaggcagcttgtggaggcgtcgttttatacatatgaggacaggggaatcggaagaaccgcggcaaaggagatatacagtgcaacccttcacggcagcgttacgaggatggaacagtacgcctcctgtgcctatgcccattttctggcttatggcctcgaactgtcggaacggccggtctatgagctggcggccgccgacatcggcaatctgttccatggctccatcgacctctattttaaacgaatgaaggaggaaaaccgttccttccgggagatttctgaggaagacagaaaaaagctggtgtcggagtgcgtctctgatgtgacgaaggattacggcaatacgattatgtccagcagcgccaggaatcagtatctggagcgcaaggtccgccggattaccgaccggacggtgtgggcattgaccgaacagctcaaaaagggagattttgagccggccggctttgaggtgacattcagtccggcggacaacttaaaagcgatgaaaattccagtttcaaaggaggaggctatccatctgaaagggcggattgaccggatcgatctctgtgaagacggagatctgctttacctgaagattatagattataaaaccggaaagacaaaatttgatttgatggaagcgtattacgggcttcagctccagcttgtggtttatatggatgcggctcttgaaaaagaacagaggaagcaccctgataaaaaagtagttccggccggtatattttactataatatagcggatccgatggtggagcggaagaaagagatggatgaggaggagacgaaacaggcgattttagaacagctcagaatgaatggactggttaacgcaaagccggaagctgtagtgcatcttgataaccgtcttgatttttcatcctcccggggagaggattcctcggtgattcccgtatcggtcaagaatgaggaaatcgcgaagaagtcctctgttgccggagagaaaaggtttgaagcgctgggagcctttgtcaaccggaagcttaagaatatggggcgtgagattttggacgggcgtattaccgtggcgccctttaaaaacgggaaccggacggcatgtgacttctgcccgtaccacagtgtctgcggttttgacttaaaaacagatgggtacggatacaggcggtttgataagctgaacccggaagatatctggcaggagattgacaaatacgcaccaaaagacggcgggacaaacggagatagccgaagcggagaaaggaggaagacggaagatgacagtgaactggacgaaggaacagaaagccgtaattgagagcagaaaccggaatctgctcgtttccgccgctgcgggaagcggtaagacagcggttctggttgaacgaatcatcagaatgataaccggcgatagcccaatcgatatcgaccggcttcttgtcatgacttttacgaaggcagctgcggcagagatgcgggagcgtatccaggcggcgatagaaaaaaaactggaagaagatcccgggaatgagcatctgcagcagcaggccgtcacggtacagtttgcccagattacgacgattgacagtttctgtctacatattctgagggaacattttgactgcattgatattgaccctgcattccgggtcggcgacgaaggggagatgctcctgctgcgcgccgaagttttgcaggaactgatggaagactcctatgcaaatggaggggaggcatttgagcgctttgtcgatacgtattcgatcggcaaggcggacggcgggattgaagattacattatgcaggttttttcatttgcacagagcaatccctggcctgataaatggttcgagcattgcagaaaagagcttgaaacaacggattttggagaactggaccggacggagtggatgcggtttctgcttgaagacgtcagaacgcaggcggaggagtgggaacggcagcttgaggatgcggtaaagctctgcatggaagaagacgggcctgaaccttatctgccgatggtaaatgaggatctgtgcaacgtaaggcagttgatttcggcctgcggttcatatctggaattcagttcggctgctgagcggttcacgttctcaagaatggcggcgatccggggaaagaattccacggtaaatccggataaaaaagaagcggtatctgaatgcagaaagcgcattaagaaatcagttgagaagatgcgggagcagtatctgttcgaatcaccggagaaaaccctggaggacatggaggcagggaaggagtccatcctgatgcttcttgcgctggcggaggagtttgcagcccggttcagggaaaagaagcgggaaaaaaatgtggtcgattttaacgatctggagcattttgccctggaggtcctgacagaggcaggaaccggaacgcccggtcctgtggccgacgaattgagccgccagttcgacgagatactcgttgacgaataccaggacagcaacctggtgcaggagaccctgattcactgtatttccagggagcggttcggcagtcccaatgtttttatggtgggggatgtgaagcagagcatttataagttccgtctggcccgcccggagctgtttctggaaaaatataacagctatacgtcggaagaaagcctctaccagaagatagaactgcaccagaatttcagaagccgcgataccgtgttaatgagcatcaatgatatctttttcaggattatgacaaagaagcttgggaatattgaatatacggatgagacggctcttcatccgggggcgtccttcgagccgtatgaaggacggaaacagggagaactggatacggagctgcttcttatcaacacggcgggcagtgagcttgaggggctggacgatgatatttccgattatacggccagggagctggaggccggcatgatagccggaaaaatcagggagctgaccggcgaagaaaacggcatggcggtctgggacaaggatgagaaatgctaccggcctgccagatacggggatattgtcatccttttgcggagtgtcagcggctgggcggaaagctttacggagatactggcgcaccagggaataccggcctttgcggagtccagaaccggatactttgatacggttgaggtggaaaccgtcttaaatcttctggctgtcatcgataatccgattcaggacataccgcttgcatccgttctgaaagctcctttttgcggcctggcagaccgggagctggctcacattactgcagtctgcaaaagaaacattgagaaaggccgggacagaggactgtattcggcggtcatgaattttctttcggagagccgggcagattctgaacacgggccggaaggagaaaagtcggggactgatgagctgtttaatgatgccgcgattgcggaaaagcttgaaaagactgtaaaattgattgaggggctccggaagatggccgtctatctgccgatgcacagcctgctccaccggattttcgatttgacgggatactacgactatgtttctgcaatgccggccggggagacgaggagagccaatctggacatgcttgttgagaaggcttcttcctatgaggccacaagctaccggggcgtattccatttcatcaaatatatcgaaaagctgaaaaagtacaatacggatttcggggaagcgtcaacagttaacgaacagggcaatacggtgcggatcatgagcatccataagagtaaggggctggaattcccgatcgttattgttgccggaatggggaaaatgttcaacaaacaggatacaagaggaaaaatccttatagactctgaattcggcattggaacggattatctggacagcaggaaacgcctgaagggtcccacgcttaaaaagaatgtaatgaagcgcaggatggagctggaggctctgggtgaggaacttcgtgttctctatgtggcaatgacaagagccaaggaaaagctgattatgacggcttcggataagaatctggacggaagaatggaaaaatggagacagatttccctttacggaggtcaggtaccctatacgattctcacaatggcagggtcctgcctggactggcttcttatgagcatccgtgaaagcggctgccggatatcggttaccagggtaaaagcagaggatcagcttgtaaatgagatagaagagcagctttccaaaaaagtctccagggaggagctgttaaaccgggatccggatcgaatttacgatgcagcttaccgtaagaggctggagacatccttccacttccgttatccatatgaagccgatgtggccctgaatacgaagatgtcggtttcagagctgaaaaaagaagggatggaggcggaagaggagacggcgttcctcccgaccctgccggtttttatggaagaggaagaggtgagggagggaggcacatccagaggtacggcctaccaccgcgctatggagctgctgcccttcagccagatcacgtcggaagatgaggtgacccgtcttctcaaccaatatacagaagaggggaagctggcgaaagaagccagagacatgatatggccgcccgatatctatcgttttttcaccaccaagctggggaaaaggatgcaggcggcggcacaatcaggaaagctgtataaagagaaacagtttgtgatgggaataccggcccgcgagatgggggactgggactcggacgagctggttttgatccagggtatcatcgacgcctggtttgaagaggaagatggcctgatactggtcgattataagacagactatgtgaacgatacccagatactggttaaacgttacaaaacgcagcttgattattacgagaaggcactgactcagatgctgggaaggaacgtgaaggaacgctatatctattcctaccggctggggcttattgctgtttgataagatagaatcccgctcgcgggattctccgcccgcggaggggcgctgcggcggcataatttcctgccgccgcaggcattggctcacttaacgagtgtaacgagcttagtgaacaagccctctttagggttgcgatcctccgcaaagcggtttcatacgttcatttctattttatatttttcagccggttttttaaactgtctgagaattcctgtgtcattggattaacgggaacattccttggcagtatgtagccgaattctatgctgtcgttgcagtcgtctatcggaattgacagtacctgataggctgatgtctgggttgtaaaatcgtggattccgattccgtaaaaatcactgcaggaaatcaggtggagcagtgaagcgcggcttgtcagataggccattctggaaccataattcaggttatattgagaatcctgggagaatatacggtatgtaaaatcttcgcattgtcccagatacctggcaaaaccgtaaggcgccagggtatggagattgacaggttttccttccctgataagcgggtggtttgtggaaaccaggatgtgcggttttacatagcacagaaaatggtaatcaagagactgggaagccagtcttgccttaaactcaccgtggcgtctgccgtcaaaatgcagaacaccgatattggcctggcccgaatatacgtcttcaatcacttcatccgccgtaccttcactgagccggtggataaatgaaggattatccttgtgctttaataccacttcaataaagctttccataatatgggaatactttgtcatggaaaccaccagcgagtgcccggtgtcactgcatgaactgcggaacgtctccattttttccacttcgcggattatattttcggcatggatcataaaatcctccccgtcaggggtaagggaaacgccgccccttgtgcgctggaacaaaacggcgccaacggcattttcaagttctttgatgatcttacccagatacggctgggaaataaagaggctctgggcggctttattgatggagccgagcctggcaacggtgatgaaatactccagatgctttaaattcatatccatattcattaaaaatcccctcccaaaagacagttacagtatatcacattgggggattgtttgaaagaaatagatttaactgaggttgggaggatgcgcccggaacggaccatgtccgatgtggtgagggggctggctgagtcttccgtccccggttggagggtgtcgtgagggggggaatccggccggaatgaattgctgcggggaccgtttacactctttggagtgcgcagcagtgctaagctcgtgagggacctcgctaagcaccggcggactcccatgtcccctccgcaattgattccgcctacttcccccggtcagggtttcgccggggacagaagactcaggcggaggttttcgcggcaccggacatggtccgttccgggcgctgattgtctctaaccttaaatggggagagccttgtcgcggccactacgtgtttccggcaggccgatatcaaaatcttccgcaatatttaaaaagcccattgatggcatatcgtatttcccgtacatggtagcactgagtggccgcgacaaggtccgcccctgcacttaacgcgtgagacattcagcggccgcaggccagtggacggggccgatacacccggctgggtctttcgtcccggcgaaaacctaaccttggggccgaggggaagataaagtctgcggatgccgttgaaatccatcgctgattagcgaggtcccttacgagcttagcagcgcgatgcatttcacagagcgagagtgtgctccgcagactttatcttcgcccgcagtcccaactcacaacaatcttcccccgggacgaaagactcataaaacaatcccaccaccccgtccgctggccgtaccggcggcgtcctcacttacttaattaaaattgttcaatcagtttgttataaggttatatcgaataggaagtatacataaaaagttatatgagttataatcaatatataatacaaaccggtatcggccggaaaggggggagaaaagaatggttcaggaaatacttgaacaggcgatggaagagggcaggaaagagattgtccatggggaaacagcttcttatataccggagctgggaaatgtggataaaaatcatctgggaatctgtatctataccgccggcggcgaagttttcagcgcgggggataccgatgtccgcttcacaatccagagtatctcaaaggtgatatccctggcagcagctctggaggtctgcggttttgataaggttttcgcaaaagtgggtatggagccgtcgggtgatgctttcaattcgctggtaaagctggatcttaccagcaactatccatataacccgatgattaattcaggcgcaatcgccgtggccagttacctgatgccggtagtcagttttgaggagatgctgcagttttccaagaagctatgcctggatgcggaaatcattctggatgagaaggttttccagtcggagatgacgcacagcgcaagaaacagggcgattgcctatttgctggagagtaaggggattatagaaagcgatgtggagaaaagccttgatctctatgtgaagatgtgttctctgggagtgacggcaaaaagcctggccggactgggaatggttctggccggaggaggcatccacccggttacaggggagcgcctgcttgatgcggatgtcgtcagggtggtgaagacgattatgctgacctgcgggatgtacgacggttcgggggagttcgccgttcatgtgggaattccgtcgaagagcggtgtcggaggaggaatcctctcagtagtcgaaaaaaagatgggtattggtatttacggtccggcgctggatcaaaaagggaatagcattgcgggtggatctatgttaagatatctgtcggagaagctgcggctgcacatgtttgccgaagaatctatctaactgcttcagatgagaaaatccggtgaaacgggttcagccgggaatggtgggtttgaagctgaaaaaagaaagggaaggtgtatatattgtacgcagaaattattggattacttagcaattggctttacagttacatactgattattctgcttttgggggcaggaatcttttttacggtaaaaacgaaatttatccagttccgttatttaaaagagagtatccgggttgtaaaggagccgaaagatgatgataaatccatctcatccttccaggcattgatggtttccaccgcatcgcgtgtcggtaccggtaatattgccggaatctccacggctctttgcatcggaggtccgggagccatgttctggatgtggctgaccgctcttctcggcagcgcctccgcgtttgtggaaagtacgctggctcagatttataaaaagagggcggacgacggaagctcttacggaggtccggcttattatattcaggcagtgctgaaaaagcgctggatcggcattctgttcgccgttgttttaatcgttacctacatgggcggttttaatatggttgcggctttcaatattgccgatacattcaaggcttacagcttttacgatgcgtccatgacgccaaaaatcgtgggaggcgttctggcaatcgcttttctgatctgtattttcggaggcggcaagcagatttcaaaggttaccggcgtgcttgttccggtgatgggagtattttatatcgcagtttcactgttcatcgtcattacacatatcaaccttgttcccggcatgattgcagatatcgtaaagggcgcatttgactttaaggcaattttgggaggctttgcaggttccgccattatgcagggaatcaagagaggattattctccaacgaggccggtgtcggttccgctccgaacgcggcggcatcagccggcgtatcccatccggcaaaacaggggcttgtgcagatgctttccgtttatattgatacgattgtaatctgtacggctacggccttcatgcttctttgctccggcgttgaaccgtctaaagagattgcaggaatgagctacgtacaggcggctgtggcaaattccctgggaggcttcggcacaattttcattacggtggccctttgtctctttgcatttactacactgatcggcaacttctactatgcggagatggggcttggctacatctgcaataagacaccgggcagcacattaatacatgcattccgtattctcgcggcagtcattgtctgcttcggcgctacgatggaattcagcgtagcctgggatacggccgatgttctgatgggtctgatggcgataatcaaccttccggttattattcttctcgcgaaaccggcgattctctgtatggacgactacattaaacagaaaaaagcaggaaagaatccggtatttaaggcagcggatatcaatctcgaagatgataccgatttctggaaataagacataatcaaaaggatgtatcaaatgccgttttgcattgtcaggcatttgatacatcctttttgccttctttgctggaatgcacagaaactgcataaaacgcagtttcgcgccgtgtaactcgggattttcgcgcagaaaacacacgaaaacacctcgcgggacataaccgtgtgaacagtaacaaaaaattcttacacttcctttaatattatgcacactctttgacaagcggtataaaaaaagttaaactggttaaaagatgaaataataaaatagaggtgagcattgtgagaagactagaaataaaacggaatattaaaacatatacggcagcggcggcagtcacagcttttgccgtttttatgcctctggcggcgacaggctgcagccgtcaggctgaggtagatgcgacggctgcgaccgtccagggagaaagcggcgcaaagacagagtcagacttggcggatttaaaagaagatacactgacggcaatcggaagtgcggatacgatggtggaatcgggaagccatctgtttttcaaataccgtggaggcatatggagtctggataaagagaccgataagctggaacagattaaagaatttgccgaaggggagttgaatggttccttttgggtttacaggggaggtctttattatgacataaattccgcaaagggagaggattcggcgaggatgtacgccctttaccggctggatttggagactggagaggagacacatctgactgatttagtcaatcaggcatcgggaatttatgcttcccgggatgttctatacgtaagcgggtataatctgaatcagacatttactctgaaggaggacggaagcctgggcgaagagcttccggtggagaaaagtatattcggacggataccggacggctgcaaggagctttacaggggagtcctgccctatatggtggagcattacggatatatgccggtacagaatgacaaatgccttgtaattgccaatgaggacggcagcggtgcaagagaagttccggaggtcacaaatacctcctccgttctgtttgataagggatttttctttgtgttattccaggacggaaacggcaatacacagtgttaccggtacgactcaaagactcttgagaagacaatgctgtttgaatcaccggataacccgcagttaatccagtacagggacgggtatctctatttcaggacgaataaagcttatcagactgtcagtgagggaacgcagttctataaagccgaggtggcgaccggggaagtttcaaaggcggcggctatcatgacagagccgggaacactgaatatgtatgacgataccggcaacttttttgtgacaggggatgccgtctactgtcaggagataaaggattacggggtttacatcggcaagacattgctcaatgcaaacgatggcggagagaagacactgattaaaccggctctctatcagtcgccgattaataagctgggacacgtggaggcggaaaagaaagaactgccgtgttcctgcggcgacaagacagcgctggagatgtatgtggagaagcttgtattcgatggtgacggcgatgagatccgtgcgatgaataaagttatggaggagcggcagcaggcgcttcttaaatcagttgacgacatggtttcctatctggatgaagcgtgggttcacagttccgacttccggaccacaaccctgacatacgaaatcgccgggattaattatctcgatgcgcgttatgtctgtgtagaggcggacggatacgagtattccggcggggcacacggcaatccgttcagagattactttgtctttgaccgggaaacaggaaagcagttaacgctcagcgatatcgtcggcaatcctgtcgaggagctgcaaaagattgtcagcaaggcattccgtgaactggctgaaaaaacaaactttgcattcgaagcgcctgaggatttggaacatacggttgcagatgacgtgagctatgattcaaaattttacctgacgcccgaaggcttggtattttattacactccctatgagatagcgccttatgcggaaggctttccggaagtgacaattccgtatggcgatttagatatgaagattgaaataaaaacagaaagctaaatgaatctcattcctgaaaacctatgataattcagacagcataactgttgccggatgcccgccgccactacattttcgcacggtcagcgcagtcagtgcgcagacctgtctgaactgttacgaaaaccagcgaatgcggaataactgacgtaaaaaaattctttacgaatattccagtctatggcataatatgtagaagaaacttgcagaataagcgcaggaggatacggtggccgaagtatcgtgctacaggtttcttcctgcgctattttcctgcagtggaatatccaaaagaaaatgggaggtagaaatggaaagtcatcgcattatccaagttgaggaaaaggttccgtttaatctgttggttcccctcagtattcagcacatgtttgccatgttcggcgcttcggtgctggtaccgtttctgttcggtatcaatccggcaattgttttatttatgaatggtgtaggaacactgttgttcattcttgtaactaaggggaaggctcctgcttatctgggttccagctttgcatttctcgcaccggcgggaattgttatcgaaaaatttggttacgcctatgcgctgggcggtttcgtcgtagtcggattctgcggctgcattctcgcttttatcatttataagtttggttcggagtggattaatatcgtacttccccctgctgccatggggccggtagtggccctgattggactcgaactgtcggggacggccgcaggcaatgccggtcttctcgatgaagcagtcgatcctaaaaatatgattgtattccttgtaacgttaggcgtggccgtattcggttccatcctgttcaggggatttttgtctgttataccgattctgattgcggttattttgggatatgtggctgctattatctgcggactggtggatttcacacaggttgtgaatgcgcctatatttgccattcccaatttttcttctcccaaatttaatccggaggcgatcatgattatcctgccggtcattcttgtcattacatctgagcatatcggccatcaggtagtgaccagcaagatagtgggccgcgatcttttaaaggatcctggactccaccgctctttattcggagataacttctctacgatgctgtccggatgtatcggctctgttccgactaccacctatggtgagaatatcggcgtcatggcggttacgagagtttacagcgtgcgcgttattgcgggcgcggccgttctttccatcgtatgctcttttatcggcaaactgtccactttaatcagcacgatcccgggcccggtcatcggcgggatttcctttttgctctacggtatgattggcacttcgggccttcgcatcctggtggattccaaagtggattacggcaattccaggaatctggcgctgacctccgtcatatttgtgacgggtctttccggaatcaaggtcagcatcggtaatatccagatgacgggaatggtcctggcctgtgtggtcggaatgattttaagccttattttccatctattggaacggtttaagctgacgaatgaatagggattcccattgaaaagatcggcaataacaagtataataatcaaaggagaattaaacaggaaataaacaggaggaagatcgggatggaatcagtaatcaggaagaatgccagcggcggaaaaggtgaaatctcagttaaatatattctgaatgaagaggagatgaacggaaagggaaagatgttctcggaagtgaccattgcccccggatgttcccttggttatcatgaacatgtgggcaacagcgagacctattacattatcagaggtgagggcgaatacaatgacaatggtacaatccgtacggtagtacccggagacaggacttttaccccaagcggtttcagccatgggatggcgaacaacggggatacggatctggtattcatggcgttgattatttacgattgatactgggaaagcggttaagctttctgcaaggcgggccgctgcacattcaggtacagcggcctgatttatcggaagaaaaggggacggagatgagaaggaagtcagggggcctgagagagaaaaacggagggataagagaaaatgccggcggcagaaagtttcagatcactctgttcggaggcatcgtgctggtgggactgctggtgatgacagtaaagacacggaccggcgccgaagccgtactttttaataaaaattcggagataacgctttatgcgaaagcgacggtaggggcggaaccggcattaaacgccgccaaattcttccccgacgaaaaactcgatccggctaaattcagctatgatctgagcgaatgtgattttaatacacctgggacatatcgaattccggtatattacggccaggaggaaacggactgtgtgatacagcttgaagtatattcatccggccgcaaggtaccggagacaacggggagcatgagcggtgattccctgagaaacggaaccgggcagtctgaaggggagactgcagattgattattcagaggcaaaaggaggcatgggatgaaattctttcatatctcagatttacatatcggcaggcagatgaacggatacagcctgagggacagccaggagaatgcgctgtcccggattatagcgtatgcgcagtccgagaaaccggacgcggtgctcatctgcggcgacatctatgataaatcggtgccgtccgccgattcctatacggtgtttgattcatttttaatccggctgtcctccatccggccgtccataccggttctgattatagcaggtaaccatgattcaccggagaggctgtcctatgcctcttcttttttagagcgccatcagatttacatatcggctttaccgccgtcgtctccggaggacaggcttaagaaggtgacatttgaggacagatggggaaaaattaatttttatttatttccctttatcaaaccgggttatgtgcgccatctatttgaggaaggggctgttaccggctatgacagcgcctttcgcgctgttctcagcagggaagagataaacggcggggagcggaacgtcattctggcccatcaattttttacctcgggggacaaggggccgtcgctttgcgattcggagtctgcgatactgactttgggcggtctggatcaaattgacgtatctgcactggcggactttgattatgccgcactggggcatctgcatggtcctcagaaggtgggcagggaggatgtccgctacagcggaaccccgtataagtattcggtcagcgaggaacgccaccggaaagcagtcaccgttgttaccatggaagaaaaaggagtggtaaaaatagagagtctgcctttggaatgtgttcctgaagtgagaagactgcggggaaccctgacggaagtcctggctatggccgattcagataactgccatgattatctcagcattaccttgacggatgaggcggaggtgttcgatcggaaggaacagcttgaggagatgtacgaccatattctggaaatacgcattgacaatgaaagaaccagaagaaagctgcgggaagacggggaaaagatagaggttcccgatccgtttgaggcattcggcctgttctacgaggcggtccgtcattgtccgatgacaaaggaacagagggaaatgatgtacaaggtgattgaagaggcaaaggacggggaggtgggcagatgaagataggggagtttgccagagtctgcaatgtcacaaaggatacggtccgctattatgtcaatatcgggctgttgataccgaagatgcagggcagccagatgagctttgaagagagggagtatgcggattttaactacatccagaagctcaaggggatgcgcttcaatataaaagagatccgggcatttctctatctgagacggatgtccaatatgattgagcctgccacaatcgatgagtgtgtgaaactgttggaggataaaaaagagtgtctcaccgtcgaactcaaaatgctcggaaacagcattcatctgattgaggacgagattgagaattttaataagaggaagaatgccgctaagaacgaacgtacgggtgtgcctgtcggtacgattccgctcctggtatgtcccaattgcagacagcatctgcacattgaaaatgcggaaattaactacaagtatatttatgagggaatactcagttgtccctgcggctaccatgcgacaatcgagaacggtatagtcaggacggaaaatatatatgaaggaagtcatgaccggcctgatttgcgccggaaactataccatgatataggagaggactgggaaatctatgtgcaaaaatgcagtgatgccataatagaacggattgacagaggtgactggaacggaaaggtaataatggaagcgaatgtcaatggtttcttctttacatacaataatatccatcaattgcccaggaactgtacctatattatcgttgacaaatattatgaagtccttgccatgtataaggagctgttcgaacagctgtttcaggggctggatatcctctatatcgcggatgcttcagaacggtttcctcttcaggacggctgcatcgacttatttctgagcttttatggagagatggaatattctctttatcacaagaatacgcaattagaagatatccttcacctgatgaaacccgacagcctggttgtaggggggattcaaagcctggagaaggaagcgaagagcagacgcctgctgcttgagcggtatccggaagggaatgaaaggcggattaacaaggaatttctggaggaagattataagaaatgcggctaccggatgtctgctgcaaaggtgggacagattatgaagacagaggatcaccatatgtatacctgtcatcttgacggagaaccgctgacgatttattattttgaggctgaaaaagagggctgaattgttatgctgaatctttaaaaagtggagtttactccacttttttgctttttttatctggttatggggattgacatgcagcagactgcaggttgtaggatgggaaaatgcgaaagaacagatagaaagaggagatgcatatgggaagaatactgacagcggttatgatggttttttttattgccggagcggcagacaaggcgctgctgaaaggaagactggggctggcggcggaatttgataagggattcaattcgaccggctcactgacaatggcaatggcgggaatcatgtgtattgccccggtggccggaaaaattcttacacccctggccgcccctgttttcctgaaaatcggggcggacccggctatgctgtccggaatcctgttttcggtcgatatgggaggttatccgctggccgtggctatgacggataacagtcaggtgcagattctttccggtgtacttctgagcgccatgatgggttctaccgttatttttacaatcccggtggccttgagtatgtgccgtgatgaagatcggagaccggtttcaaagggggtggttctgggaattattgcgattccctttgggcttattacgggggctttgactgccgggctgcccggacggatgattttgaccaattcggtgccggttattgccatagccgcggcactggccgttattttgactgtttttcccgaaccgacactggccggctttaaaacattcggggatatactgaaatgcatctgcatactttccctgacgctggcgtcgttggaggaggcgcttgggattacgctgctgcccggaatggatcctttgggggagcagttgaaaataatcgggctgatcggagtgacgctggccggagcatatccgtttatccgtgtactcagcaggtgcatgtccccagtgctgcgccgcgtggggaagatactggacatcagcgatgcctcagtggccggaatccttgcctcccttgccaatcctcttccaatgtttgacctgataagcgaaatggatgaccggggcaaagtggtggcgatggcctttgccgttcctgctcttgccgtattcggagatcatatgggctatgtttcggccgtatgtcctgatgccgtaatcccactggcggctggaaaactgaccgcaggcatagtcggactgattctggcggaaatctttgagtctgctcctctttttccgtccaaacgaaaagaaattgtaaaaaacaggagccgaatgtaaagttttcgaaaaaattacagaaaaatactagttgacatggagctgtcccaacatgatagcgttaagacatacaattactgaatcccgggaatggtaaaagtaaatgaaaaagtcaagcagacaaaggaggaagtaacatgagcaatcctatcttaacgtttacaaattgggtgtggggatatccaatgttaatctggctggtgggtggaggcatctttttgtccttccgttacaagtttatacagtttacaaagctgggatttgtacttaagaacacaattgtaaaagcgtttaaaggcggagaaataaacagcgacggcaacaaaatttcaggctataaggcggtgacgggagcgctcgcatcgacgcttggggccggaaatatcgtgggaacggcaatcgccataggctacggcggcccgggcggcgtgttctggctgtggctgacaggcctttttgcctgtgtaattaaatatagcgaggtagttctcggtatgaaataccgtcagcgggataaagagggaaaatggtttggaggccctcagtattatcttccgaaggcgacagggtggaagtggattggatttgcctatgctatcagctgtgctttctgcctgttccttgcagcttctgcccagatcggctccgtggttgataccgttgagacaattcacattccgcgtatcgtatcgacagccgtgctgattattgcagcggccctgattgtacttggaggtcttacaaggcttttgagctttacggaaaaaatcgtgccggtcatgagcgtgatatatatggcggccggccttgtcgtcattgtattaaatgcaaaagaacttccggcagcatttgcgtctattttccagtatgcatttacaggccgtgccgctgtcggaggtttcggaggcgcgacgcttgccatgtgcatcagatggggcgtgtgccgcggtgtctattcgaatgattcgggtaccggagttaccacaattacccatgcggcagcagatgtgaaccatccggttcagcagggaatgtggggaatctttgaggtattctttgatacaattgtcgtatgcagcgttacatgtctggtgattctgacaaccggcgtgtggcagacggacgcatcagtatccacgctcaccattgcaggattccagaaagcgctcggtcctgtggcaggcggatttattgtctctctttccctgacattattctgctttaccacagcggtggcgcagacattattcggatgtgatcagctggtgaaaattttcggggaaaaggctggaacatggggaaaatacgtttacctcggactgatgtttatcggaggcatggttggaatcagcgccctgattaattacgtggatttcggctccttcctgattatattctttaatatgattggtgtttacctctgtcatggggaagtcaggaagctgacggaagaatatttctcggatacagaaaaatgggagacacaaaaatggcagccttgggttgaaatggaagagaaggacataagaagcagccatcacgaatagacgaacagaaaaaatattaacaaatggaggaagaaacatgaaaccattgataggcatcacatgtaattatgattacagggatgagattgggagcgtatcccatatggggatagccggacagaaatggcattttctggcggacaattacattgattccatagaacgggcaggagggatcccggttatgatacccatctgccggaatatggaaacagtaaaggagatggttgccggaatggcaggcatcctgttcagcggaggccatgatatcaatccgcaggaatatggggaggacgctaaaagttactgtggaaccatcatgccgatgcgggaccgccaggatgtggatctggccagatacataatcaatgagaccggtaaagcggtactgggaatctgccggggaatccaaattctcaatgtcgccgctggaggaaatctgtatcaggatttggagaaagagggcgggttcggccatcatttcaatgatatgtatccgatgaacagcgtatcccaccgcattttggtaaatgaggggacaaggcttggaaaaatcctgggaaaagagacggccggggtgaattcgttccatcaccaggcagtcagggaaccgggaaccggcttcatcatcagcgccgtgtcaacggacggcgtgacggaggcaattgagatggaaggcagccgttttgtcgcggcaacacagtggcatcctgagatgatgcacgattcggaagaacagcaggcaatattcagggcattcgttgaggcgtgccgggtaaaataattactccagggaggcatttaaattccgcagtaaaggggatttagagcgcctccctcttttggtgtaacagttcagacaggttgctgctactaaaacatatggagatttagttaagcaggtgaggacgccgccggtacggccagcggacggggtggtggggtgtgtatatgagtctttcgtcccgggggagaattgttgtggtttggggctgcgggcgaagataaagtctgcggagcacgctcccgctctgtgaaatgcatcgcgctgctaagctcgacaggacctcgctaaacccccatgcctctgatgcggcaccaccataaatgaaactgcgagggcggcaggtgattgaaattgctgttgattgagcttatactgacattaacggcaaaaatcggcactaatttgggcctgtagcccgttcgctaaactgattttaggtactctcatttgcaccaccatctgtccagccgcttgcggcagaaggacgtacagtaaaataataatagacagagtaccgtgccgtaaattttattttggaggtaaccatatggataaagtttacgacaaatgttgtggtattgacgtgcacaaaaagctcatcgtcgcctgctttagaaaaggcagcaagcaggagttacggaactttggtgcaacaaccagagagcttcttgaattagctaactggcttcagaacggtggctgtgaaatggtcgcaatggaaagcacagcgtcctattggaagcctctgtataacatcctcgagtcttctgaactaaaggctatggtggtgaatgccagccatatgaaagcagtcccggggcggaaaaccgatacaaaggatgcggaatggattgcggagcttcttcagcacggattattaaaagccagttatatcccggataaacagcagagggagttaagggaactggtccgctaccggaaaagcctcgtgagtgaacgcacccgggaattgaaccgactccaaaagatgctggagggtgccaacataaagctgtccggtactgtatctgacatcaactgcatgagtgcgcgcaacattctggaataccttctcaccggagaattcttcgacgaagcaaagtatgatgaaatgtataaacagaaaatcattgcccacaatctcaaagccagcaaggaacagcttatcgatgatttaaatggtgtcatgaccccattacaacgtcgaatgatgaaagagctgctgtcccatctggatgaactcaatgttcatatcaacaatctggaagatgagattgataactttatgaaaccggaagaaaaaaaagcgacacaagcaatccaggatgtaactggtatcggaaaaaacagttcccaggccattatttcggtgattggtacagacatgagtcgttttccaacggccggtcatcttgctgcatgggcaggactatgtcccggcaataacgagagtgcccaaaagaggaagaccggaaaaatgcgaaaagggaatgctcttttacgttcaaccctggtagtctgtgcgcattccgctacaagaaataaaaattcgtacttttatgcgcagttcatgagaatcagttcccaccgtggaaaaaaacgggcttatgttgcagttgcccattccatgcttatagccatctatcacatactcaaggatggagttgttttcaaagatctgggtgctgattattacaaccaattcaacaaggaacgtaaaattaatgcgtacctaaagaagttaaaagcgcttgggtgggaggttccggtagttgccgcctgaacctgttagctgagttcaaaataaacgtcaaaaaggttgatgggggaagtctgcgcttttttggcttcccagaagttaaagtttcacagtaatcagcgatggatttcaatggcatccgcagactttatcttcccctccgccccaaggtcaggttttcgccgggacgaaagactccgccaagtatatcggccccgtccgctggcctgcggccgctgaatgtctcacgcgttaagtgcggggcggaccttgtcgcggccactaagcgcttccgtgaacgggaaatacgatatgctttcaaggcacctttattaaggaattgtggaagatttgatatcggcctgccggaaacacgtagtggccgcgacagggtcctccccatttaaggttagagacaatcagcggccggaacggaccatgttcggtgtcgaaaaaatctccgcctgagtcttccgtccccggcggaaacctgccccggggaagtaggcggaatcaattgcggagggaacatgggagtccgccggtgcttggcgaggtccctcacgagcttagcactgttgcgcactccaaagagtgcaaacggtccccgcagcaattcattccggccggattcccccctccacaaccaacttcccacggggacggaagactcagccatccccctcaccacaccggacatggtccgttccggacgcgtcctccaacctcagttaaatctctaattaggtcatagtagcctcgccgtctgaaaattctggtacaagtaaaatgatttatggtataatgggctataattcatgttcagaaaccaggagaggagcgataagatgaaacccttaaaagtaaccatgtctgctttcagttcttatgcaggtatcacggagattgatttcgaaaaggtagatcacggcctttttctaattaccggagatacgggagcgggaaagacgacaatatttgacgcggtttcttttgctctctatggcgagaccagcagtgacagccgcgacggcacaatgatgcgcagccagtatgcaaaggacggggatgagacctgggtggaacttgtctttactgataaaggaaaggtctaccgcatcaggaggaatccggcctaccagcgggcgagcaaaaggaaaaacagggatggagagcgcacggtcactatggtgcaggcaaaagccagtctgatcctgcctgatggcagcgaatatcccggacggctcagcgagataaatgaaaagatccgggagattgtaggtgtggacaggaaccagtttgcccagattgcgatgatagcccagggggaatatatgaaactgctccacgcgtcgtcgaaagacaggaaagagatattttcccgggtgttcaatacgggaatttattggaggatccagcagaagctcaaggaaaaaaacaatgaactctatattaagctgaaggacaacgagaatttatgcttgcatgaactggcccagatttccctgccggaagacagtggaggactggaggcgcggtggcgggaggtatcaggaaaactggaaaccagaagcgaagagatatcagagctgctgagcgagatagccggggagagtgaaaagcaggatagggaagcggccgggcggcaggagcagttaatagaaaaactatctgtccttaaccgtaacctggagcttgccagggaacagaacagacggctggatgaatgcgaagcggccggggaaacgcttaaaaggctggaactggaagtgccggaacgcggctgtgatgccctgaaactgaagcgtgccaaacaggccgaaccgctccggcctcttttgatgaattgcgagtcggatgaaagcgagcttgcccggacaggcgaaaagataagggggctggagcaggagcttgcggagctggccgtgcctctgggagaagcggaaaaagccatgcaggacaggatgtgcgagctgtcaaagcggcgtcctgagctggaactttccgcaggacggctgagggaggcaatgccttcctatgcacatctggatgaaaagcttaaggaggctgtgaacgccaggcaggaagcagacagactgaagaatgaaatggaggcggcggaaaaaactctgagggagctggaaatcaggaggaaggagctggaagggcagggcgcccgtctggcggaagtcccccttgcactgtcaggaatgcagggcagggaagaggcggtaaaagtccgcctgtcggatttgaggcagttacagtcggatttggaacttcaggagaggcttgaacatgatctggaagataaaaaaagacaggttctggcggcacagagaacatttgagaaggccgaggcggaatatgcggagataaaccgcttgtttatctccatccaggccggtatcatggcatcggctttggaagaaggtgccccctgtcccgtctgcggctccctgcatcacccgaagaaggcggtgctggaggcggaagcagtcaccgaaaagcaggtggaagaggctaagaagagaagggagagggcggaactcacactacggaaagcggcatcggagagccaggaatacggaatccgttcagacgggcaggctaagctggtcagcgcgctgacggcaaaactgctggagggagatgcatcggctgaggaaagtgctgcgcttgagaagaatgcgccggaccgtagaaatatcaaagaacagaggcaatgggtgagtttggcaatcggagcatgccttacaatggcagaggaaatatcgaaggagcgcgcccggctggaacgtgaggctgaagaactggagcggaacaaaacgcagcaggattccctgagaaaaaaatgggatgaacagcaggagggactgcgggaactgaggccgagggctcaggaggctgcaatccgcagcagccggatacaggttgagacggagcagcttcgaaaaaatcttttatgggaaagcaggagtgacgctgagcgggagctggagcgcctggtgaacgagagagtgctgctggaacaaagcgccggggaggcgaaggacaaagccgacaggataaaaagcagtataacgcaaaaggaggcttacctgtcttccgagagggagagagaagccgtactggggcggaaggtggaagaaaacaggaaaaagtggcaagaagctctgaagaagaatggttttgcaacggaagaagagtataggaattctgttttgacggataatgagatagccatgctttccgaagatatggaaagattcaatcaggagctgttaaaggcgaggacgatcttccagcagctcagaatggcggcaaaaaagcttacgcgtgtggaagaatctgagcttttgaaggaaagggatatgctgacggacgaaaaagcaaaagcagcggagagggcagggcttttgtcggcccggagaatccggaatgagggggcatacaggaaccttcaaaagctgatggaggaacgcaggaagctgaaggaggaaaaacagcagatagaaattctctataccactgctgacggaaaggtgaccggctctgccaggatagatttccagacctatattcagagacagtatttcaggcagatgattcatgcggcaaataagagactctgcatcatgacggacaaccagttcctgctgcaatgcagggacatggagctgctggggatgaaaggcgaggtgggcctggatttagatgtctacagcatgagtacggaccgaacacgtgatgtaaaaacactctccggcggagaatccttcatggcggcgctggcaatggccttagggatggcggatgtaatccagagtacggccgggaaggtcaatattgatgcaatgtttgtggatgagggcttcggttccctagatgagtcttcccggatgaaggcaatcagaatcctgaaggaactggccggagatcgcagactggtgggaatcatctctcatgtgacggaattgaaagagcagattgacagaaagcttctggtcacgaaaaatgataagggaagctttgtgcactgggagctggaagactgacggcggctttaaaacaatgcttaactgtattcgcacatcttgctcaaagcagaaaggaaacagacatgtcagaaatatttatgatatcagacacacatttcggtgataatggagccatcttaaggtacgagggaaggccttttaaaaacggcccggagatggacgggaccctgattgccaactggaacagaaccgtgaaaaaggaggatgttgtctatcacctgggtgatgtggcctggaatatggataaagaagctttaaaagcccttatatcggggctgaacggcaggaagatactggtgatgggaaaccatgacaggaattttaccgtcagggaatggatggagacgggctttgaagaggtgtactctcttcccgttgtgctggagggttttttcatgctttcccatgaaccgatgtatgtaaattcctacagtccttacggcaacatattcggacatgtccacggaaacccgatgtacagggataagtccagccacagcttttgtgcctgtgtggaacgcatcggatatacccccgtacagtttgagaaaataaaaaacgagatgtccagggagcagcgtttggaggctgcagagacttaaaattagttaccgttcagccttcggccaaactgcaactaatgatgcagcggctgaacggtttctaaaattacaaaaatcgacctgcgcatctggaatcacccggccttttgtgctatagtaaaaaagatagcgattgaacgatagacagaatgaaaggtgatggaagtgacaattgtaataccgggagtgataaccgtatcatttctttccctgttttactgctgtatgatgccggaagtcggcaggaaagacaggctggaagcatttgaaaaacagtacatagcccacaggggctttcacgacaatgcgtccttcaacccagagaatacaatgcctgcctttgagaaggcggtggagaaagaatatgggattgaactcgacgtccagcttacaaaagacaagattcctgtcgtagtccatgattatgacttgaaacgtgtggccgggactgcccgcaggatagaggactgtacctttgaagaactaaaaaattatccgttgttccgttccggacagaccataccggcgcttcaggatgttctgcgcatggtggcggggagagttccgcttattatcgaactcaaggtagagagaaaattcagggagacctgcgaggctgttgcaaagctcctggattattatcacggtacatattgcatcgagtcgttcagcccacttgcgctgtggtggttcaagcatcaccgcccagaggtggtgagaggccagcttgccacgaaccacaggcgggaaggactgaaaacaccctggtatatagaggggattcttacgaactgcctgttaaacggattttgcaaaccagattttatagcctacaactgccgttttacaaaaacttttccggtgacggtcctgcgcaaattttacagatgcaagatggcggcctggacgatccggagtcagaaagagcttgaaaaacataaaaaatattttgatgtgtttatatttgacagtttttctccggaggaggataaattaagcaggtgaggacgcagcttcaggccagcggacggggtggtggggtgtgtatatgagtctttcgtcccaggggaagactgtcgtggtttggggctgcggccgccgattggctcacgcgtaagtgcggggggcagaccttgtcgctaccactcaatgcttccgtgtacgggaaatacgatatgccttcaatgcgccttcttaaaaattgtggaaggtttgatatcagactgcctggaacacgtagtggccgcgacagggccctccccatttaaggttagagacaatcagcgtcccttccggacgcgtcctcccattctcaatataaatttcttaaaagaagttgcatttttcataaaacctgttacaatgatagggacaatttaataatgagagaatattacgaattcaagaggtaaatgagatgaaaaagagacacctactttcaggcgtaatggcacttctggtatctgttgcactcagcgcatgcggaggcgataagaatgcgggaggcacctcggcgggagagacgaaacaggaagcttccgcagaagaaaccagtaatactctttcagaaggaacaccagtaccaggcggaagtgttgtattcggtatgacacaggacctggctagtcttgacccccacccagagacggacgcaggaactagagacgtggttttcaatttgtacgaagggcttgtaaagcccgcttcagacggcagtttagtgccggcagttgccagtgattatactatctcagatgatgcaaagacctttactttcacattgagagacggtattaccttccatgacggaacaccggtgacagttgaagatgtcaaatattccattgatcgatatgcggagattcagggcgaatcctccgctttttctatgctttcggacgtggtcataaaggacgacaagacaatcgaggtgcttttgaaagagggagactctgagtttatcacagagcttgcgctggcggtaattcctgcttccaacgatgatccggcgggaaacccaatcggaacgggaccattcaaatttgtatcctacacaccgggacagaacctgattctggaaaagtacgacggatactggcagaaaggccttccctatcttgacagggtggaattcaaattcacaccggatgtggatactgcgttcatggagcttcaggcaggcaccatcgatattttgaagtacctgactacagcccaggcccagtccttaagcagtgaatataaccttgtggaaggcagcatgaacctggttcatggaatgtacttaaacagcggctatgaaccgctttccaatgcaaaggtgcgccaggctctctgttatgccgtggacagggatgcaatcaataatttcctgtttggcggaaagagccgtatcatcgggtccaacatgatcccgaacatgacaaaatattatgagccgcaggctgaatcagtctatacttatgatgtggcaaaggcgaaggaactgcttgccgaggcgggctacccggacggctttgatctggagattacagttccaagctcctattcccagcatgtggatacggcgcagattattgccgacgaattatcgcaggcaggcgtaagaaccacaatcaagcaggtggagtggagtacctggctggaggaagtttacaagaacggacagttccaggctacggttattggttttgacggaacgctggctccgggcaagatgctccagagatatgtatccgacgacagcaagaactttatgcattattccaacgcagagtttgacagggcgttcaaagaggcatatgaagcagttgacgatgccgagaagacggctaaatataaagaagcccagatgatcctggcacaggatgcagccgcagtatatatcgaggatccggccaatctggtggcggtaaataaaaagtttgcaggctacaccttctatccgacatcggcggaggatatgtccctgctgtaccagattgcacagtaaaagaataaaatatcggtaagtaaaacagaataaatacaaaagcagtaaataccaggagggaattatgaaattctttattaaaaaactgataactctcattatcacattgttgttgatctccttcctgacgtttactgctttttctgttattccgggaaatgcggcgctttccaggctcggaaaggatgcctccgaacaacaggtggaagcgcttcgggaggagatgggactcaatgattcccttccggtgcggtatgtccgatggattggcggcgcagttaccggagatttcggcgagtcataccgctatgaaggcatcagcgtaagttcgctgctgtccgaccggctgccggttaccgtccttttatccgtcatcgcactggtcattatcctcgtatgttccgtaccgcttggaattgcaagcgcgcgtcatgcgggagagtggggcgatgtcgttaccaatcagctgacccagataatcatggcgatacctcccttttttctggggatgatactgacctacgtatttggcctgatacttcatttattccagcccgggaagttcatccagccgtcggaaaatctgggggaagcggtcaaatacctgttttttccggctttggccattgcacttccgaaaattgcaatggtagtcaagtttttgcgcaactcggtgatctcggagatgaacaaggattatgtgagaaccgcattcagcaagggaaacacaagaacgggcgtgctctatagccatatcctgaagaatgctctgataccggttatcactttttttgcattggtaattgctgagatactggccggaagcattatcgtggagcaggtcttcagtgtgccgggaatcggaagattactgatatcctccatctcgaaccgtgattatccggtagtgcaggccattgtgttatacataacggccgttgttgtcattattaactttattgtggatgtgttataccagttcctggacccgcgtgtgaagacgtcgtaagagaagacggaaggtacgattatgaagaaaagaaattacaatctgattatagggacttcaattaccctgttctttctggcggctgcagtgattggccggttttggacgccttatggggcgacggccatggattcgttatccgtcaatctggcgccatgcctgacgcatccgatgggaacggataactttggaagagatattttaagccgtgtcatgaatggaagcggcagcacgttctttgtggctgtctgcaccgtgctgattggaggagtattcggcaccctgattggagcggtgaccggatattacggagggtggctggacgatgtcgtcatgcgtttaaacgatatgctgctttcatttcccagtattttgctggctttgattgtcatcagcctgatggggccgggcagatacaatattattctggctctgggggttctttttattcccagttttgcacgtattgtgcgcagtgaagtcatacgctgccgtgagcttgattttgtcaagagtgccaaaattatgggggcgggggatttccgcatcattttcctccatattctgcccaatgccggagtcagtattttgacggccgccgctatcggttttaacaatgcggtgctggctgaggcaagcatgagttatctcggcctcggtatccagccgccggaaccgagtcttggccgaatgctgtcggaggcccagtcttatatcttcaatgctccctggtacgcgatttttccggggatcacaattattttaattatattgggattcagtatggtcagtgaaggcctgagaacccttcaggaataggaggaaagccgtgaaaccattagtagaaattaaagatttgaccattggctttcaggaggggaagaccatatccccggcggtgaagggaatcagctttgaagtaagggaaggggaaatcctgggtgttgtcggagagtccggctccgggaaatccatgagcgcgctggcgcttatgggactgcttcctaaagatgcgattgtaacacaggggcagatcctttttaaaggaaccgatctgctgacgatgaaggacgaagaaaagagaaagcttcagggcagcaggatggccatggtgttccaggaaccgatgacctccttaaaccctgttatgaagatagaaaagcaggtgggggagagccttaagctgcatacctccctgtctgataaagagatacacgaaagggtgactgccgctcttgaggaagtgggactttcagatccggaaagcctttgcacgaaatatccgcatgaactgtcgggcggaatgcgccagagggttatgctggcccaggccacggtctgttcccccgacctgattatcgccgatgagccgacgactgctctggatgttattgtccaggcccagattctgcgtctgctgaaaaagatacacagggaaaataatacgtccatcctttttatctcccacgacctgaatgtgataaaggagatctgcgaccgtgtgattgtcgtatataagggggatatcgtggaggagggggtaacccgggaggtcctcttaaacccgaagcatgactatacgaagcgcctggtcgcctccataccggaggaccatgcggccggaggcaacggtcgggaaatactccgcctggaagacttaaacgtatactatgatacaagggcaggcgccttctggaaaaaaaagggcaaaaagcatgtcattcacgatgtatcgatgactgcctatgacggtgaaatcctggggatcgtcggggagagcggctgcggcaagtccacgctgtgcaagacgattctaggacttcataacaactataccgggactgttaaaatggatgataatctgaggccccagatggtgtttcaggatccgttcagttccctgaacccggcaagaaagattggatggattctggaggagccgctgcgccttcgcggcattacggacagggacaagcgcaggcagatggttgcggacatgcttgtcgatgtcggcctcgacccgtcatttgcggacaggaggccgagggagctgtcaggcggccagagacagagaatcagcattggaacagcgcttttgatggattccaggctgatcattgcagacgagccggtatcggccctggatgtcacggttcagtctcagattttaaggctgattctgaggctccatgatgaaaagaaaatgaccatcctgtttatcacccatgatttgaatattgtgcggcggatatgccgccgggtggtggtattgtaccggggagagatcgtagagtcgggacttgcggaggagatataccgcgcaccggcccatccctatacggaactgcttctgaattccgctccggacggagatacggctgcgtcggagaaggcggtggcagatatcggagaaggcgttccggccggtttccggggatgtttcttctacccgagatgtccgaaacgctgcagccgctgccgcgaggcgaggccggaggatacgatggttgctgcaggccatacggccaggtgtttccggctgatgtaaacttttgtaaaaacctttttcttgtaacctttccctgtttttagtataatgaagttgtaaagtgggaaaatgatacagggagggaagcatatggagaaagaaatcggccgtttacgtgaaatcttaagaaacagtaattacacagttgcgctctgcggctccggaatgacggaagagagcggttttatcggcatcaaaaagccggaacgtgcttatgaaatcgagcgtgtttatggagcgtctccggaagaaattttcaccagctcctactacaatacccgcccgatgcagttctttaaattttaccatgaagaaatactggataaaataccggaaccgggcccttccagccatataatggcggcgatggagagggcaggccatctgcactgcattattacttctaatatttttgatcaggagaagaggggcggctgcgaaaatgtaatcgatctccatggtacgatttttatgaaccgctgtcctcactgtggtgaatattactcggtagaagatatacaaaacagtaagggagttccttactgtatgatatgtcattcggtgatccggcctctcgtttccctttttggggagatggtggacagccgtatcatgacgagaaccaccgaagagatcgaaaaggcggaggttctgctgctgttggggacaacaatgcagtccgaggtgttttccaactatgtcaggtactacaatggacacaaccttatcataattcataaagaagagcattacatggatcataaggcggacttggttatcgttgaggaacctggcaatgtactctgccagctgggatattagaatattccgtgtttctaaatggaaatccatagttaaggaaaaagggctgccggcggcagcccttttttgcagaggaaataatacgcgggcgtgacctctacagttttaatttccgcattcaatgctgatttcgttaaatttatccagcagatcttccaccttcgtaccttctttgtccttccctgtctgatccagtatagcatggccctggtgcatcatcagaagacggttgccgtactccacggcatagcggaggttgtgtgtgaccatgatagtggtcagcttcttttcccggacaattttcccggtcagttccatgataatctcagccgttttcggatccagggcagccgtgtgttcgtccagaatcagaaattctatgggggtcattgtggacatcagaagagccatggcctgtctctgtccccctgagaggacgccgaccttaacctccagcttatcttccaggcccagccccagcatgcgcaggttttcacggtagaagtcgatacgctgcttatcagtaccgcgctttaagttaaacggcttcccctttgtatcggccagagccatattttccaggatcgtcatattggggcaggttcccatagcaggattctgatagacgcggccaatggtgcgctggcgtttaaattcaggcatccggctgatatcctttccgttaatgatgatccggccgctgtcaatggggatgctgccgcagatgatatttaagagtgttgtcttgccggaaccgttgcttccgaccacggaaacaaattcgttctcattgacagtcaggttaaaatcctcaaacaggcacatctcattgatggttccctgattataatacttatcaatatgttttaattccagcatttatctcaccttcttctttccgttttcactgactacaaggattacgaggaagaacgcagaggtgataagctttaagtagagtgtcttaaagccgaccgccatggctgcagagacgcatgctttatatacgattgttccgagtatgacggccgtcgtcgctttcagcttcccgaatctggcaaatacttttgttccgataataacgcttgcaaggcccataacgatggtgccggtgccgacggagatttcaaagaatcctttctgctggcagtatacggcacccgagagggcggcaaggccgttcgccagagccaggcccaggattttaacggagcctttgtccttcgcgagggaagtgacaagggtttcgttgtctccaacggcccgcagcagatatccggaacgcgttttcatatacagatcgaggagtattttgactgccgccacgatcagaagaagaatcacaacggtgctgaattcattcaggggagaggggagcccgtatacgaactcattgtcaaagatcgtatcccggctgaaaatcggcagatttgccttatcgcccgtgattcgaagattcagcgaatacagggccgtcatgacgataattcccgaaagaaggtcgcgcaccttcaatttgacatgaatcagtccggtgaccgttccggccagagcgcctgccccaaatgcaataaacagagtgagaaccggcggcattcctgccagaatcaacgtggcggttacagccgctcccattgggaatgtactgtccaccgacagatccggaaagtccaggatggtataggtgatgtagacgcccagagccatcagtgcatagattaaaccttcattcaaaacgccaagtataatagacatggcaaacctccaaatttcttcttaatgtcggcagaggtgaaaagcccgcggggcaggcttttcaccgtctgttgctgaggacggtgacctgtgcgcagagcgtacaggttatcgttactgtgtgatctcgtcgaacatttcggcggcatttgccgtcaggctttccggtaatgtgatacccaggttttcagctactttagtattcccataaaaggatgcccctttaatcacttcaaaattcatttcgctggcttttgcctcgccttttaatactttggcggccatctgtccggtctgtcttccaagagccacataatcaaggccttcagatgcaagacagccgactttgacctgctccacctcactgccgaataccgggattccctttttattcgcagcatccagaacaacctggagagagcttacaaccgtgttatcggtcagattgttaatacagtctaccttctgtaccagctggtctgcggccagcgggacatcggccgcggatgaaacgccgctctctacgatttcaaatccgtattcaggagccgctgctttgtattcttcgatggtggagagggagttaacctcgcttgtgctgtacatgattccgattttttttgcatcgggaagcacttcgcggatcatctggagctgttctgtcacaggaagcttatcgctggtgcctgtcacttcccctaccggtgaaccatccgcattggcaagctctgccataaccgggtcagtcactgccgtatagataacaggtgttcctgtttttcttgccgcactgtatgcactctgagcgattggcgttgcaatgccgcagattaaatcagcctttttagagataaagttagtgataatctggctcgatgttccgccgtccgcgttggcattctcatagaggattgtaagattttcaccttccacaaagccttcctcggccaggccctggataaaaccttcacggcagttgtcaagggaaccgtgtacggcaaactgtccgatgccgatagtatatttcccatcaacaaggtttcctgtattttcttccccggcttttgccggttctgtttctgttgctccttctgagacagcttccgtctttgcaggctctgaggtttcagccttatttcctgatgaagagcagcctgataatgccgctgcagccatagcgccgattaataatgatgcaaatactttctttttcataattctttcctccattaactgtttttatgattttaattagactgagtctgctcggcagactcccgcgccggagcgcggtcgttttggcgacataattccctaccgccgcagtgcgatcctccgcggagcggtttttatttaacggaagaactttcctgttaaataaaaaaagccccagacacagtttcctgcatctgggacgaatttataaatccgcggtaccacccaaattgacgtaaagtccactcattcatatactaacatatatgccgccagataacggttgcggtttccgtcagcccatactgttgttcagggctgccctcaaaagtccattcggttaccaacttcatactatgcttccaccatgacatagctctctgtaatgtcgtaagataacttactcctctttttcaacggttttattttttctaatcctaatacttttttcctgatttgtcaatagcgtttgcagaaaaaatatgatataatcgcttttaacagaaaatggaaccggcaggccttttggggagaggccgtccggctggatgaaaggggattgtactgaaatgaagaaactgctggtagtgattgacatgcagaatgattttgtggatggctctctgggaacagaggaggccatgaaaatcgttccggaggtgcaggcgaggattgagcagcacaaaagcgaggggcaggaggttgtctttacaatggatacacattatgacaattatcttgagactctggaaggaaagaaccttccggtggaacattgcaaaaaggagacagaaggatggcagctctgcagccctcttagcgggtatgaagggaagcgttttgaaaagccgacgttcggaagtgtggaattggcggcatatgccagggataaggattatgactcaattgagctggtgggcctgtgtacggatatctgcgttatatctaacgcacttcttcttaaagcggtgcttccgggcactccgatccgtgtgagggccgcctgctgtgccggtgtgactccggaaagccaccgcaatgctctggaagcgatgaaaatgtgtcagatagaggttatttagcactgtaaaataatatttgacgtcttactgcaggctctgtaaaggagaacggatgaaattagccaagtctggaaaatattgtttatgtgcttttataatcatattcatatgtatatatatggccgtaccggtcaaagcggaagcgagacgtgtagtgcgtgtgggttttccggagcaggagggatttactgagaaggggcgtgacggccattattccggatatacctatgattatcttcaggagctatcgcagtatactcaatgggaatatgaatttgtggagatggctggtgacatcaatgagtccttaactgccctgctggatatgcttgccaacggcgaaattgacatgcttggcggtatgacatatagcgatgcgctggcggagatttatgattatcccggaatgtcatacggagaagtggggcttgttctagcggttgaggatgataattctgaattgaccccggtcaattttaccggccgtgaaatgttgaaaatagctgtgaccggtaatggcgggcgccagcaggatgcgatgattaaatacctcgaattgctcggccagaattatgagctggtccactgcgcttcctgcgaggagaagcttaagctgcttcgggaaaataaagcggatgtgatgatggatactgaggccggaatctcaaaggaatgcagaatcattgcccgattttctttttcacccttttatctggctgtgaccagaggcaatacggagctgttgaaggaactgaatgcagggatggcggaacttaaggaaacagacccacttctgataggcaggctgcatgacgaatattttaacagagcggcgagcaggctcatttatgaagaaaatgagaagtcctatcttgcacagaataaaaccttaagggcagttgttttaaacggtaagcttccgatacagaatgttgcagcgaaaacaggagaggcagagggaattgccgttgatttccttaactatatctccgaggagacaggtttaacgattgaatatatcggcattacggatccggaagaataccgctcggtaattttgaatgatcaggccgatatcattttagcgcttcccggttcccctcagcttatggaacagtttggcattatccatacgctgccctatatgaatatttcacagatattggtcatacacaaaggactggaaccgggggaactgaaagggaaaacggcggctacgtacgatgcattcggaaaccgggatgaaaatgccggggaggagaagctgtattattcaccggaagcggccatggaggcagtcgatcaaggtgaggcggattactgctacatagataactattcgtttcaatattgtattaataagagagtttataaaaatatttcctctatcgtgctggccgagagtggcagccaatctatcagtatgggcgtggtaaaagattcagatttggttcttcacgggattttaaataaagtgatcgcatatatgcccgaggctatgaaagagagcattttttacgaaagctcgatcagccaggaacggacctcgtttttagaatatgtcagagccaatcctctgccgtttgctgcggcggttctgcttttactgacggcagccggagcggcttccctgcacaatatcaggaacagatatgagatgagccgcaaaatggctctggaatatcagcgttacagacagctctcagaagtagttggagagtgtatttatgaatatgatttccggggggatgtcttaaaatttcttggtgacggtgtgtataagctgggtgtgcctgagacgatttccgcgttcagcgtttacgggaagcagcagcttgcagtgcgggaaatcccgcctgaagaatccctgtatcagtggatcatggagaagaaggacgggacaaaggatgtccaaatcattttcgccagggaacctgaaagatggtatcgtgttacatcgaaggtggttaaggacgattccggctatcccgtgtattcaatcggccgtgtatgggatatccagcaggagaaaatcgaaaaagacagactgcttcaaaaggcacaaaacgacggactgaccggtatttataattccgctaccatccgtgagaacataacgaaagcacttaatcagtccagctttggcggcgctcttctgattatggatatcgatcattttaagtcgatcaatgacaggtacggccactccgtgggtgatcatgtgctgacacaggtgggcatgaaaatgaagcacatattcaaaggcgaaatatacggcaggctcggcggggatgaatttgtcgtcttcctgccgcagcagatgacgagggaagaacttaagacaagggtggaaggcgcctgcgaagcttttaagacgatagaggcttcccccggctgggacaaaattacggtcagcataggtgttgcagtgagaacagacgagacaaagttcagcgatttatatgaaaaagcagatttactgctttacgaagtgaaaagggaaggccgtaacggatacaggatcggataatacgattctgtttccgttacggccttccggctatttacgtttaagcctggcaagatcggaataaaaaccgggataagagatattaacacagtccgcgtcgagtatttccgtctcgccttccgcagccagggctgttacggcgaaggtcatggcgatccggtgatcttttttactgtcgattacggcgccgtggagcgggcggccgccgtgaatgatcattccgtcctctgtttccgtgacatcggcgcccatggctctcagattttccgccatgacggtaatccggttggactcttttaccttaagttcggcggcgtcgcggattacggtagtgccctttgcatagcaggccatggcggcaagcatgggaagctcgtcgataagggtcgggataatgcttccctcaatgacggttccctgcagggctgaagaccggaccagcagatccgctgtcggctcccccgattcatttttacggttcaggattgaaatgttaccattcatctgcctgcacacatgaagaataccgtcccgggtcggattgatgcccacgttgcggatcagaacctcggaattcggaacaatcagggcagcggcgatgaagaatgcggctgaggagatatcaccgggaacggtaatacacaatccttttaaagcatttcccggtctcaaaacagccgttgtattttcagtgcggatatcggccccgaacgcggaaagcatcagctcgctgtgatttcttgagatataagattctgtgacacgggtttctccttcggcataaaggccggccagcaatacggcggatttcacctgggcggaggccacgggtgactggtaatggattccatggatacggcatccggtaattgcaagaggagcacagtcattgcaatggatacttctaatctttgcccccatcatggaaagcggttccataatccgcttcatgggccgccggcagatggattcatcccctgtcagggttacatcgaaatcctgggctgccaggattccgcagatcagccgtgtcgtggtgccgctgttgccgcagtccaggagctctttcggggcggtaagcccgcgcagccccctgccgtgaatcaggacagtttcccccttattctcaataggaattcccatctttgtaaaacaggaaatggtggagaggcagtctgccccctgaagaaaaccacgcacctcggtaaggccttcggcaatagatccgaacatgatactgcggtgtgatatggatttgtcacccggtatggtcaattcgcccgataaacggcgggctttggagaatttcataaacagaacctcatttcatcttcattcttctttcgggcatcagccgagaaagagtgtataattgtaatttttaaggcgtacccaggcagccgtcatggaggcctcatcatagaaggaaatccggagggcgccttccccgtgttcacggttatggttaatgccgatattcataatattgatgccctggcctgccagaatcgcggagattatggatatagtgccgggttcgtccacaacgtcaacagagaaggagtagtctggcgtgacggagccctttgaattgtctgcaaaggaattccggtagtcgcgtgaggattcgaacagccggtgaatggctccggaatctttactctctacatccgtaaggatatggcccagtgattcaatataccgtttgaggataactgctatattggcgtcgttggtcatgcagatttgttcccacatcacgggggaggaggaggcaatgcgcgtaatgtccttaaatccgccggccgcaagccgtttcattgtctgattctcattatcacagtcgtgaaccagatttacgaggctcgaggcgatcaggtggggaagatggctgatggcagccacgataaaatcatgctcccggtagtccagcacgagcggaatggctccgatggcttttgcaacccctgtcatgcgttccgtgaaggaagacggagtctttcccgtaggcgtgataatatagtaggcattctccaggaggtggtcggaggcattctcatagccggtcttttcggaaccggccatcggatggccgcctacgaagcagtcctccatcccgagagatattaccgtctcatggatattcgttttggtgcttcccacatcggtaacgatagccccctttttgacaaacggtttgatctgctgcagataatcggcattatattccacgggggtgcagaggaaaatgatatcacattccgacaggtgttcgtcgacaccgtccagaattacatccacaatcccatcccgctttgcctgtttcagcttctctctggtgcgcatgtacgccataatcctggtgcccggcgctctacgctttagtcctttggctacagagcctccgataaggccgagtccgataaacgcaactgtcaaatctgtcatagttaatcctccgtaaatgtattcgtaacgttcaggcaacgataacctgcacgctccgcgtacaggtcaccgccatcaatatgagtaacagtacagactgcataaactgttacaaatatgaactgttacatcgattcattaatcaaaatgtcctgcccgaaagcccggcataaggtctgaggcggttcatcagtccgtcaaattcatcgaaagtcagggactggggaccgtcggaaagtgctttttcagggcatgggtgtgtctcaatcatcaatccgtccgcgcctgcggcaatggcggccttggataaaggctccacgtatgccctcacgccggtcgcatggcttggatccacgataatcggaagatgcgtcctctgcctcaatacgggaaccgcgctcaaatccagcgtattcctggtagatgtctcataggtgcggatcccgcgctcacagagaaccacattttcatttccctcagacataatatattctgcggcattcagccattcatctattgtagcagataaaccgcgttttagtaagatggggagggaagtttttccggcttcttttaaaagttcgaaattctgcatgttcctggctccgatctggagcatatccacatactgtacggcggactcgattgcatggccgctggtaacttcgcagataacggaaagaccggttgcctctctggcttccttcatatatttaagaccctctgtttcaaggccctggaaggagtaaggggaggttctcggcttgtaagcgcccccgcgcagaaaggttgcgccggatttttttacggcaaaagccgtctccatcaactggctgctgctttcgatggcgcagggaccggccataacggttaaggtctttggcccaatctcggtattctgcactttgattacggacggctcggggtggaatttcttattggccagtttgtaggactctgtgaccgagacaaccttgtcaacgccgtccgtgatctcgatgttggaaccgtacagcctcgtcttatcgccgacaacgccgatgatggtcacctggtcgcctttggaaagatgagcagtcagccctttcgattcaattattccggttactctttttaccgcttcttcggaagcgtttggtttcattatgacaatcatgttctaatcccgctttcttgattaataattattatgagtaaggaggacgttcccgtccgctgactgtctccatcctcaactaacattattgcctattgtagtgcagaaaggaaaagttgtcaacgatttgttgcgttaaactgcaacagtttaacgtggggaaaacaaatggaggattaaaatacggaaaaaccccgggattttcaattctcttgtgcgaaattggcataaaatttgtataaaatgtgaattttacttgaaattttctctcttttcttgtacaatatcaacatggactaaaatttatctacgggaggaatttttatatgaacgtgtatgggacaaaacaaatccgtaatgtggttttattaggtcatggcggcgccggaaagacaaccgtggcggaggctctggccctggttacaggcgtaactaagagaatgggtaaggttccggaaggttccactatcagtgattatgataaagaagaaatcaagagacagttttctatttccacaaccctgattcctctggaatatgacggagaggacggcccgattaagattaacctcttagacactcccggttattttgattttgtcggagaggttgaagaagcggtcagcgtagctgatgctgcgattattgtcgtgaactgcaaggccggaattgaagtaggtacggagaaggcatgggaactctgtgaggagtacaatcttccgagaattatatttgtaacaaacatggacgatgatcaggccagcttccgtgagctgattctgaagctggagaagcgcttcggaagaaagatcgctccgttccaggttccgatccgtgagaatgaaaagttcgtaggttttgtcaatgtcgttaagatgaagggcagaagattcacaaatctgagtgattacgaggaatgcgagattcctgaatacacaaagaagaacctgggtattgtcagagacgctctgatcgaggcggttgccgagacgagcgaggaatatatggaacgctatttctcaggcgaagagtttactcaggaagagatttccgccgctctcagagagcatgttacggaaggcaatatcgtaccggtacagatgggctccggtatcaatgcacagggcttcagccatctgctccaggctattgacaagtatttcccgtcgcctgacaaatttgaatgcgtcggcgtggatgtttccacgggcgagcgttttacggcgaaatataatgacgatgtttcactttcggccagggtatttaagaccattgccgatccgttcatcggtaaatattcactgatgaagatttgtaccggcacattaaaaccggacagcgtgatttataacgttaataaagacgcggaggagaaggttcagaagatttacctgttaagaggcaaggatgttatcgaagtgcctgagttaaaggcaggagatatcggtgcggtaggcaaactgtccgttacacagaccggtgatacaatcgcagtccgcacggccccgatcgtttatcacaaaccgaaaatttccacaccgtatacatatatggcttattcagccaagacaaaaggcgacgaggataagatttccagcgcgcttgccagactgatggaggaagatctgacgctgaagaccgtcagtgacgtggagaaccgccagagcctgctctacggtatcggcgatcagcagctcgatatcgttgtaagcaaactgcttgccagatataaagtggatatcgttctcagcaaaccgaaatttgcattccgtgagactctcaggaagaaagtggaggctcagggtaaatataagaaacagtcaggcggacacggccagtacggcgatgtcaagatggagtttgaaccatcgggagacttagagaagccatatgtattcgaagagagggtatttggcggagctgttccgagaaactacttcccggccgttgagaagggaatccaggaatgtgtcctgaagggaccgcttgcaggttatcctgtggtaggtttaaaggctgttttggtggacggttcttaccatccggtggattcttcggagatggcgtttaagatggcggctactctggcattcaagaaggcattcatggatgcgaacccggttcttctggagccgattgcttctttaaaggtagtcgttccggataaatttaccggcgatgtaatgggagatctgaacaggagaagaggacgcgttctcggtatgaattccgatcaccatggcaaacagattatcgaagcggatattccgatgtcggaactgtttggatacaatacggatctccgttccatgacaggcggaatcggcgtctactcctacgagttcagccgctatgagcaggctccgggagatgtacagaagaaggaagtggaagcgagagccgccgaagccgagagagactgatagaattttgagatttccgatgttttttaaacagtaaatatagggatatgagtagaaaaacagggctgctgcaaagagatatctttgcagcagttactttttagcagtgaaatattttcaggtatgtcattcactgcctgcgggcgtgattggttgaaatttcagacaaaacgcggtgatgtccaacaaagtgtagtgacttttgtcggtaatgccatcttattctggtattttatgcgcaaaatgacgaaaattaaaataatgcttacaaaacacttaaaaatgtggtatgatttatatagtgtggtataagtatgccggaattacagaagcggaaaaagcaaattttcccgtattcaatagagcggtgaggggttcgcgaaacgtaacctttcatcgttttgtattgattggcggtgaaaaactcgcagagagtgctagagcgtaaacattggcagtttgttcagaattcaggagggataacatgaataaaggcgattacatggttcattggagcggcaaggtctgtatggtggaggacatggccgagatgaatttgacaggtacaaagagaatgtattttattctcacgccggtaagagataaggcagaaaagatctatgtccctattgaaaagacggagggaacccttcggccggtgctttcgagaaaagaagcagtctcacttgcgggaagaatcagggatattgaaccccttcagattaaagatgagaagcagcgcgcccaggaatataagacggcttactattcccaggattatttgaatctggtcagaattgcaaaagaactgtatcagaggaaagaaagcagagggagagaaggcaagaagctcccgtcgaaggatgcgcagatgatgctgctggtagaaaagacatttgaggaagagatggcggtggcccttggcgttgagaccagtgaggtgaaaaatatgctggaggcaggaagccggacataatttaatatacagcagattcggtgcgcaggcatcggaaaagcggcaggaaggagacagcgggagcggattaaagtatcccgctgtctcttttctgccgctttttaacgtcctcatcgtttgctgaaatacagggaattgtaagaaaattgcaaagattggaaaatgtttctattgtataataaggcaaaagcagaggttatcttaaagagaaccggcgggaagatgagtaaaggaaaaaggatgatatgcataggataacagacaggatgatattgaaggcgagcgtattgatcgtactgctgtgcctcattttcgggatttgttttagatacaggtacaggctggctgagccggtttttgtgcagcagaatacggcggtaacggcaatatttgatgacagtgaagcaaaaccggggtggtatgcagacgttacattttattatattacgggaagaggagatgacaggctggtacagcacattgatttttcgcagctccagccggcagggaataacgcaggggatgaggcatccctgaaggaatttacagagacgatagaatcaaaggggcagtatcttttgcacacgctgggaggaaagctgtttgtgccgtccggggagccgcttgaaaactacagagtggtgacggaagggaacgtgtattatacggacgggagcagtgccgtcacagaactgggcaatctgatctttgagccggattcccgggtaaacaccgttgctgaggtggtatcggtttcatctggctcagaaggaaagagcgagatggtggtgcggatgaaaagcgccgccgcactgaaggtgaaagaggtactgattccggagcgcacatccggttcctttcatatgagattaaatggtatagagctggcgccggggccggatttgggaaataaggagcttatgaggtttgagaagggcgatgtatttaaaatggacagccggtgggacggggatagccgtttcgacgatccgtcgggactgatttcaaccatcatgattctggaactggagggaaaggcgcggcagacgcttctttttgtccattccgtgcttcagccggcaggaggtaattttattaatatgtggaaatatctgaaccagaggggagtgttttaaatgaatagcagaagcaaaaagatattttggggactgctgattgcgtcccttcatatcgatctgttcgggcttgtattgcttccggcctgttttggcttcgcaattttgtatttcggaatttatgatctggaaaaggggggagcgtcatttccgctgacccaaagacagatgaaattttatcatgctctggcagcggctcttgttctgctgtccggcattattgtatttacttcaattattgacattctgcccgattcggaggtatgggaggtacttccttgtgtgcttgaatatatagtatgttttgtattgatggaagtttatgcgggaagaaaaccttctctggcgggactgaagagggggtatgccgttgtaatgggactggcgctcatcggatactgggccagccttttcgtgggttcagccggctggcagattttcagttccgtaattatcctgatatgccgcgtgatggtgctgaccgctgcatacagtgacagaaaatatgaggcatcggagcctttggaggaaaaaagtcctttgataaactcttctgatatgagataatagagtcagtaggcagtatagaatttatgtgactatttcagactcatacggaggttacagcagatgaggatcattgattttaaggaaagcaaatgcatgcactgctataagtgtgttcgttactgcgatgtaaaggcagttatgatcaaagacggaagggcagaggtcatagaggacaagtgcgttctctgcggccactgccttcatgtctgtccgcagtcggccaagacgatggccagcgatctcgatacggtgaaatattatatcaggcaggggcaccgggtagtggtgtcactggccccggcttatatgggctttttgcaggaggggaccattggccagatccatgaggcgttcagaaagctgggattcttcgatgtcagggagacggctgagggagcggcggccgttacggcggaatatgcaaagcttttagaagacgggaagatggagaatattatcacaacctgctgcccgagcgtcaatgacttgattgaaatatactatccccggctggtcccatacatggcgccggtcgtatcccctatggtggctcatgggaggatgctcaagaaggaatacggggaagatgtgaaggtcgtatttgtaggtccctgtattgccaagaagaaagagtccacggatcccaggaactttgacagcatcgatgcggtgctgaattttaatgatatcaggaagtggatggagtccgagcggatctcgatagaagactgcggagatgttccgtttgagcgcctggagccgcaggtgaaccagttatatcccgtcaccggaggcatcattcactccgttttatccacaaaggaacagaaggacggatacaggaagcttcatatccacggaacgaaaaattgtattgaattctgcgacagcctgatggccggtgagataagcggcagctttatagaaatgaacatgtgtacaggcgcctgtatcaacggttcggctccgctcgacagaaccgtatccagattccgggtaaagatcgatatggaggaaaaggtttcaagggagcctgccgacagggtaaagcttcagaaaatgagcgagggagtggggcttggcaagcaatactccgatcactcaacgaatgatttaatgcctacggaggagcaaatccgggagatactggcaaagacgggaaaaaggacgccggaggaggagcttaactgtggagcctgcggttattccacctgccgggaaaaagcggtggcagtcttccagaaaaaggcggagattaacatgtgtattccctatatgcatgacagagcggagtctctggcaaatcttgtgatggatacttcgccgaatcttgtgatgattgtggacggggatatgaagattttagagtactccgcagtcggtgaaaaatattttggcaagtccagggccgaagcgatccagatgtacctgtttgagtttatcgatacagaagatttccagtgggtctatgcgacgcatcagagtatcaggggaaaaaaggtatcttatccggagtataacctgtcggctctgataaatattgtatatgtggaaaagaaggatgtagttctggcgacaattatcgatatcacggaacaggaaagccaggccaggaagtattacgaaaagaagctgaacacagtggagctggcccatgaggtaatccgcaaacagatgacggtagcccaggagattgcgggacttctaggagagacggcggccgagacgaagatcacactgctggacctttgcgattcacttctggaagaaggcgaaaaagagcaggggacgggaagtggaaagagaaggcgcgggactgcttctgcggaaccgggttccgaagctgaaggcaggagatagaagatggaaattaaagtcgatatggcatataagagcctgaataagaatgaagaagagctgtgcggtgacaaggtggagattctgcacacggataattcccacattctgattctggccgacgggatgggaagcggcgtgaaagccaatatcctggcgacgatgacttccaaaatcctgggaacaatgtttttaaggggcattcctctggaggaatgcgttgagacgattgcggaaaccctccctgtctgccgcgtcaggcagatggcgtacgcgaccttcagcatccttcaggtctatgatgacgggaccgcctatctggtggagtttgacaatccgggctgtatttttatccgggacggcgaaattatgaagataccggaacagttccgcatgatcgacaacaggcgcatcaatgagtaccattttaaggtgaagctgggggatgcttttgtcctgattagcgatggcgccatcaatgcgggagtcggagagctgctcaatttcgggtggaactgggacagtgtggcaaaatacgcgcagagagagtataaaaagacaatatcggccatgcatctggccgccgcgatcagccaggcatgcgacgatctctaccagtaccggcccggggatgacacgacggtggccgtgctgcggattggggagaaaaaactggtcaatctgatgaccgggcctgcccagtgccaggaggatgatgagggtatggtaacagactttatggccgatgaaaatgcagtaaaggtggtctgcggcggaaccagcgccaatattgtagcgcgggtgctggaaaaagaaatcaatgtggcgtttaccggggagattgatccgaatataccgccgaccgccagtatcgaaggaatcgatcttgtgacggagggagtggtgacgatgaaccgtgtccttaagcttctggagcagtatacgagagacgatgagatagatgaggcattctttatagagctggataagccgaacggggcgtcgatgctggcaaaacttctgattgagcaatgtacggatttacatttgtttgtcggaaaagccgtgaatgcggcctatcagaatacggaactgccgtttcaattgggggtgcgccagaagctggttgatcagattgaggatgtgttgaaaagactcgggaagggagtttcggtgagatactattaaaataatttgggcggattatgattgtccaggatgatatgcttatttaatgaagctgcaaaaccgatggttatcaggcctgtcagtattgcagctttctcattttacaggaatgaaaattttaacttcgttgtccggagcgtcaaatgccagcaccgatgattttctatatattcgattgccctttctaaaggggataattgaatccgtttttatgatacgctatgcaatgagacttaacatgatttgaaattcaaggagaataaaatggcggatattatcgtgcaggacctgacccaaaataatctgaaacattaaaaggataatatcaaatggaagaacatgacatacagttgtcgtactgattgtgttattataatacaaggagcaatatggtgaattttcaagcgcactccaatgcaagatcatacaagaaaaacatatcagaatatgatataatgaaaagaaacaatgcgcacaggccacggtctttgatgtaagcaatggaaggggccaccgccggagtgcgccgactggaaaatatgataaataaaaacactgatttacaggcaaatttgggacagttgcatacgacggaattaggcgttatgagaatacggcggaatctgtccttagacgtggaagacgtggtgggatggtgcacaacgaagattgcatccaacgctgccgttattacaagaaacggcaaaaactggtatgtaactattgataactgtattataacaatcaatacgtacagctataccataattacggcccacagggtaaagaagaagtgttaagcgcccgtgtgcaaacggctgctggacccggctcagttttaacgttcggacatagacgggattgcctcacagcgcattttacagcgctgtggttttgttgaaatacggcgggggaaacaatatggtggagactttgaaaagatagaggggaactgttaatgacagcagaagaagtttttagtgcgttgtacgataaatatggcgtagactttaactggcacttgcttccattattacaggcaaatggaaactttgtcgaggaattgaagagagaaattgggaatgaccattttttgtatcataaaaaaatttgggcagtggcaaagtgcgattcaaatgatgatgtgctgtatgttaccggaaatgaattggggacagacacctattatatttttcatttgacttactcagcgcataattcagatggatttcctaaatatgaggagtttcctgatatatatgcaatgaaaaaatttattgaacaatcttttgtcgaaaattacatgtgaactaacacatcgaaaacggcagcaggctaaatggctgggagttaccattgttaagaatcggaaaatcaggatttataaggggaaaccgtcatgtatgacagaatgcttgacaagcaaaacagaccggcttttgacgatatggccgcctactgtggaaaaagtatgaaattatttatccgtatcaatgaatggctgtcggaggtctgcgaaacgacacaggagattgtctttccctatggaaacaactacggatgggccgttgcccacaggaagaagaaaaagctgatctgtaatgtgtttgcggaaaatgacgctttcaccgttatggttcgtctttcgaatgaacaatttctttcattatatgatcggatgggggaagaaaccagaaagtgtatcgacaataaatacccctgtggtgacggaggatggcttcattaccgggtcaccggtgaggctcatttttgcgatatacaaaaaatgctggaagtgaaatgcgcattatgaatggcagaatgctgtttatagagaatcggcaaattcgtggaaggggagcgatatggaacaatttgatgttctaatcaaaaaggacggtatttcataaaacaaagggaactatttacgtgaatggtacagtcaacgacatagcataccgcagtaataagctggagcccgtttctgtgattgcatttggctggccggacgaagaaaaagaattacctccccggcgggaaacggcaatggtgcattatgacagatggtaaggtttaccggcctgttatttagaaaggaatttaatttgaaatataataggatcatactattgaagaacaataaggaatgctgtttgagaaatggcagtgaaagcgacggaccggctgtattggataattttaatttaacgcattctcaaactgattatttgctttcctatccggatgaaaatacttttgattcgaagcaggagagtaaattcctgaaggaaaagtccgagagtgaaaacgagattgagataattgcagtggtcgataatatagtggctggaactgccgggcttgaagcgataggcacgaaatacaaggtgcggcatcgtgccgaatttggtattagtatcgccaaagagttttggggattgggaattggatgggcattaataaatgcctgtatcgaatgcgcggggaatgctggatatacgcagcttgaactcagtgtggttgctgaaaatacaagggccatatcgatgtatgaaagggcaggctttgttgaattcggcaggaatcccaaaggctttaattcccgtactgcaggatttcaggaactgatttatatgagaagggaattgtaaggcataagatgagagagattattgatttcattgaagcaaatgtgaatggcaggacgctgtttacaaaggaattggtttatgaacttgagaacggcgggttacagggcgtatactcggatcagatatcttcggttaagtagtcttccgtatagattgaagtaaataaagagctgtctgtggcactggtatattgatataccggtgctttttttgatgacgggaacctgtgcgcggagcgtacaggttatcgttattttaacaggaaaactttcctgttaaataaaaaccgctccgcggaggagcacgcgggcgggattctttccgaggcatggcggcagatgaaatttccgataattttacaattatttacgtaaatttcgataaaacttaacctttttctgatagttagctcaatagtgcagtgttattgtaagaacgttagaaaaaatgaatgagaaagaacaggaagtaaaggagacagagcagaatgtcacaaattgaactgcggaatgtgaacaagacttatggaaaaaacaattgtgtgattgataatttgaacctgcggattcccgacggcagcttcacggttatggtaggccccagcggctgcggaaaatctactactctgcggatgatagccgggttagagagcttaagctccggtgatttgtatatcgacggaatccgggtcaatgacatggaaccgggagagcgtgatattgccatggtattccagaactatgcgctctatccgacgatgagcgtgcggggaaatatcgagttcggcctaattaatgcgaaagtgccgaaggaggagagagacaggcgaatcagggaaatttgcgagattgtaggcttgtcgccttatctggaacgcagacccggagaactgtccggagggcagcgccagagagtggcactggcacgggcaatggtaaaacagccgaaggtgttcctgatggacgagccgctttccaacttagatgccaagctgcgaaaccagatgaggacagagctgattgaattacataaacaactgggaaccacctttgtttatgtaacccatgaccagacggaagccatgtctatggcaactgatattgtgctgatgaaccagggagaaattaagcaggtggattcaccggagaaaatctataacgatccggataacctttttgcggcacaatttatcggcaacccgacgatgaatctctttaaaagagaggaaatgggtccgcttctcaggcttcctgtagacattgaaacgattggtttcaggccgtccaaggtccggcttctggagacaggggatacggtcagcgaaggggaactggttacttcaggtccgattcttacgagggaattgatgggcagtgagatcatataccggattcaggcgccctttggagtaattacatttaaaacattcaatgaaaaacagctcccggaggatcagacggtccgggtagcagttatgaaaaagagtatgtttttctttgataaagccggaaggagggtgcgggtttgaaaacagtaaagccttatctgcttattgctccggcgctggttcttctgtgtgttttttgtatttatccaatcttcaatatgattggcttaagcctttatgagtgggatatgatctcgccgtttaaaaagtttgtaggcctgcaaaattttgtaaagctggctgccgacaaacagttttttcagacgctccttaatacggtcatctatgtggcctgcaccgtcggcttcggcgttggtttcggactgattctggctgtcttcctggccaaaaagacgagactgaacgggctgctgcagagcgtggcattttcaccgtatatcgtgtcactggcctcgattgcgctgttatggatgtggctgatgaacaatgactttggatttttaaatgccctgctggccgtattcggcattccggccatagattggctgggcagcccgaaatttgccctgatgtctcttatcattatcaatgtctggaaaagcgtcggatataatgcgctgatcctggtatcggcgctgcagggaatcccgccgcatctttatgaggctgccaggctggacagggccaatacatggagaacgttcagccggattacgtttccgatgatatcgccaaccgtattctttttagccctggtggacgtaatcgcagcttttaaagtatttgaaacaattcagatcattactcagggcggccctcagaattcaacgaatacactggtgttctcactctatgaatacggatttcagttttacaaagtgggatatgcggcggcgattggtgttgtattgtttttcattgtgctgctgtttacgatactttactttgcggtgctgtcaaaacgtgtccattaccaatagagagggaggagtaaaccatgattgcagtagataaaaaaaagcctctgattcctggttcaggaggcatatcaaataatgtgcgggaaaatgcccggacgcggatatacaggaaggcggcggcgcgcagtgcggcgaagctggcaagaaatctggcaagcgccgttttgctgctgatatttttctttcccttttactggatgatcatcacatcctttaagtcattgggagagacaatggtgtttccgccgtccctgctcccgaagcagttccatttatccaattatgcaggagcattcagtgcatttccttttatcaggttcctggttaattcctgcattgtcacagccgcggtcctggcgctgcagatgatgaccgtgataccggccgcctatgcattttcccagtaccagtttaagggaaaaggatttttattcggcctgaccttagctacgatgatggtgccggcgcagctgatatttctgccgctgttcgtcctgttttctaaaatggggcttattaacagctatgcttcgctgattcttccattcggaaccagtgcattcggcatattcatgctccggcagacctttaaccagatgccgaaagagcttgtggaggcagccagactggatcgggcaggagagtggaaaatagtcacacagctctttcttccgatggcgcggccgactcttgtgacaatggcgctcctgacttttatcaacacctggaatgattacttctggccgcttgtcatgacaaccaatgacacggtcagaacgctgccggtgggagtcgcctccctgcgcaacatagagagcggcattaactataacatcctgatggccagcaatgtaatgctcaccataccgattgtggccgtctatctgctggcccataaacagattatcaaagcattcacttatcttggagataaatagtccttctccggatatgggaaatataaagtctataaagacacaaacgattatgagaagacaaaaggagaacatcgacatgaaaaagagaactacaacctgcatcctggccgcaatgatggccttgtccgcctgcttatccggctgctcgaccggtacttccggttcagcttctgcgtcatccgggacccagggcacgtcatcgggagaaagttcagatatcatacagttgacttactggtattcctggcaggataaaattgctgaaaacaatgtggagcgcatacaggaatttaacgagacggtcggaaaagagaatgggattcaggtcactgccgagtatcagggtacatacgatgatctgcattccaagttaaagagcgcatttgtggccaacgaggagccggatgtctgcgtaatggagatagccagcatgaaaccgtttgccgacggaggcattatacagccgattcaggagatggtggctcaggaggacgtggatgatttctacccgggcctgatggagaactgttatgtggacggagtcctttatggagtcccctatttaagaagcacgcctgtcctgtactataataaaacgctttttgaaaaggcgggactggcttcggagaaagggccgtcagactggaaggaactggcctccatgtcaaaacagcttgccgatataggagtgagcggatatgggtttgtatccgatatctggatttatgaagctttccttcgatgcaatagcggcgacacggtgaatgaagactggacccgggccgtattcaattcgcagcagggcgtggagatgacacagtttctgcgggacggcctgcgggagaacaattttaaatattacagcggaaataatgcctccgacgccattaaaacagatgaggttaatcagaaagtggcgatgtgggtcgcttcaactgcaaatctgtctaataaccttcagcttgcctccgataacgggtatgagatcggcacggcttttataccgaaaaacacccagaataaagtaccgaccggaggctgcaacctggttatgaccagccgcctggagggaaagaagaaggaagctgccgcaatgctgattaatttcatgtcaagcaaagacagtgcggtgaaaaaccatattaaaacggggtatctgccgacaaggaagagcatcagcagcgatgagcgcctggtggaattatatgaaaaaacaccacagtacaaagttgcccttgaccagctccaatacggaagcggaaggccgatggcacaggcgtatacggagatgacaaaaacgtatcaggaaggaatggataaaatcatgacaaccgatacggatatccaggaagcgcttgacgagtgtgcggcggcctgcgactcccttttaaaataaaacagatacaggaatgcaggcacaagacccgattgagaaacaactaaaacagaagagcagacagtttagacagcgaggagagaaaaaatgtccagattagtagtaatgtgtgttgacgctttattcacgacagacttggaggatgcagccaggatggagggctttgccgccatcatggatcatgcgggaatctataaaaatatcgaatgcgtatatccaactctgacttacccgtgccatgcaacgatcatgtcaggatgctggccggaccgccacggaatctgccataatgaaaaactggatccgaagaccaataaccgggaatggtactggaactataaggatttgacggtgaaaaccatttttgattatgcaaaggagaataacctgacgaccgcggcatttgaatggccggtcacagccggagcagatatagactacatgattccggaaatgtggacttacgatcatacgccggatatgagggaagtgcttcttccaaacagttctccggccatgaaggaaatttatgaaaagaactgccatatcatgaactggaaggaaaatccgcggtttgacagcttccaggtacagtgtgcagtcgatattattcaccggtataaaccggatgttctctttatgcaccagtcccatctagaccacacccgccatgtatacggactgcatgcaccggaggtacaggaggcgctgcggctccacgacggatggatcaggcaggtgattgaggcactgaaagaggaagagctgtttgaagacacgacctttatcatattgggtgatcacggtcatcttcaggtcgattacaacatctgccctaatgtgcttttggcaagagaaggtatcgtgaggacagacggcgccggcaatataagagaatgggacgcgtatatccagtcctgcggaatcagcgcccaggtctacattaaaaagcaggaggcggagggaattgtgcttcgtctgctgggagatttaaaagatttgggatatgtgagggatattttcacgaaagaagaggtgaaagaaaagttccatttagacggagaattttcttacatgatcgaggcggcgccgaattatgcctttggcaatgcggcatgcggagatctgctggcagggacggatacgacggactataaatattctgtggctacccatgggcacttaccggccagaggcgataagccatgtttcatcgtccgcggagccggtgttcccgaaggcgtatttgaaggagccagattggtggacgaggcgcctaccatgatgaaaatccttggactttcctatggggaaggagaaatggacggagcgccgctgttttaagggatacacaggtcaccgccgtcaataagggaagcagcaccggaggaaagcttgaacctccggtgctgcttcttttatgaatttatatttatgcctctaacagctggccgaatcaattacaaatcatagtacattttaaattcagccgggttcgggatctgctccatttcaagcagctctttgcgttttcgttccagccaaatctcgattaaccgctccgggaatacgcctccggccgtcagatactcgtgatccgcctcaagagcgtccagcgcttctccgagtgatttcggcaggcctttgattttctttttctcctcctcggttaaatgatagagattgaagtcataaggcccccatccgttcttgtgaggatcgatcttattcctgattccgtccagtccggccatcaggagggcggcataggcataatatggattagcggtgccgtcaggattacggatctcgaaccgctttgtatccggtgattttgcataagccggaatacggatgacggcgcttcggttggaggtggcatagccaatcgttacaggagcctcatagcccggcacaagacgtttgaatgagttggtggacggattggtaaaagcgcagagcgaagcgatatgcttcagcaggccgcccataaaatagtgggccgtctcactgagtccggagtaaccgttctcatcgtagaaaacaggctggccgtctttcttcagcagcatatgtacatgaaggccgttgccggcttccttgtaaatcggcttcggcataaaggtggctgtctttcctgcttttgcagccgtgtttttaatcacatatttgataaccatggtattgtcggccatcgagacaagatcaccgagctccacctcaatctccatctgtccgggaccgccaacttcatggtggtgatatttcacctttaccccccagtcttccagcgccagacacatctggttcctcaaatcaaaaccgatatcctgcggggcagcagcatggtagccgcctttgtatccgacctcataaccattatttgcgatatcgtcccggccgctgttccattctgcctgacgtgtatccagatgataggcgcttttctgcggagtaacctggtaacttacgtgatccaggagataaaattcaaattccggcccgatcagcatctcatcggcaactccctgttccttcatatattcaactgatttcttgcatacatttttaggatactggtcaaacggggtattgctgtctttaccgattacacatacatcgccgctcatcgtcagcgtaggaatttctgcaaagggatctacggccgccgtgtccggatccggtataaataccatatcgcttttttcaacaggagcgaagccgtagttggaaccgtcaaatccgatgccataagtaaagatatcctcggtaaaacgtgcaacagggattgttacatgatgccatcgtccgttgatatcaatcattttgaaatcaatcatcttaatctggtgctcttcgcacatgttacgtacatcaatacttgttttcataaagatatctcctttgctgattgtggtaaatggttaaatatatataaatattatataatttattgtgcaaaatgtataatacctattgattataacattatagtttgtaggaataaccgatggaagggggaacgagaagaaagcataaataaacgaccgcacaatcatgcggtcgtttatcaggtactgtttgcaccatgctaaaaggcggcatactgtaaacaataacacactttgcgatgcacggaaactgcaaaaaaacgcagtttcgcgatgtataatccggattttcgtgcagaaatcgcacgtttcttttcacggattaatttccatttatccgtctttttacatagctggtatgcagcagatgatgcgctttttcgcttccgggttctcccaggaaggaggcatataattcttttatcgccggattctcatgggattttcggattgtattggctttgtcggaattatacagcacctgggcgcgcaggccgcggatatcgacggtatcccgcacgtagccgggctgctgaggctggccgcctccgtttacacagccgccggggcatcccatgatctcgatgaagtggtaggacgcctcgccggattttaccttgtttaaaagttctctggcattattaaggcctgatgcaacagctacctttacatccattccggccacattgtaggtggcctccttgatacccgcagtaccgcggacttccgtgaaatcgagagccttcagctcctcgccggtcaaagtttccacggctgtacggagagccgcctccattacgccgcctgtagcgccgaagatggtggctgcgcctgtactgagtcccagaggggaatcataggatgcatccgggagcgcggtaaatttaattccggctttccggatcattctggccagttccctggtcgtcaaagcgatatccacatcaggtacgccgttggccgcctgatggtcgcgtcccacctcgaatttcttcgcggtacacggcatgatgctgaccgacacgatgtccttcgggtcaattccggccttctgggcgtagtaggatttggcaatcgcaccaaacatctgctgcggagacttacacgatgacaggttcttagtcatatcagggaagtaatgttcacagtatttaatccatcccggggaacaggaggtgatcaggggaagaacgcctccgttttgtacgcggtcgagaaattcatgggcctcctccataatggtgaggtcagcgctgaaatccgtatcaaatactttgtcaaagccaagcatcttaagcgcggataccatctttccctccacgcctgtgccaatcggatacccgaattcttcaccgagagcggcgcgtaccgccggggctgtctgcacaatcacgtgtttggcgggatctgcgatggctgcaaacaccttgtctgtgaaatccttttcctggagagctccggtcggacatacggcgatacactggccgcaggatacgcagcttgtctcgcccagtcccatgttgaatgcggaaccgatattcgtaacaaaacctcggtcattggcgccgattacgcctacaccctgaatactttcgcaaactgccacacagcggcggcacagaatacatttgctgttgtcgcggagcatatgggcagcgctgtcgtcaattaccgacggcgttttttctccgtcatataaaccttcgtcgtccacacccagctcgcggcagagggcctgcagctcacagttggcgctgcgcacgcaggataagcattttctttcgtgattggagaggagcagctgtaatgtctttttcctcgaggccaatacctgcggggtgttggtccagacttccatgccctcattaatcgggtatacgcaggaggcaaccagggttctggctcccttcacctctacaacgcagatacggcatgcgccgatttcattgatttcctttaagaaacacagggtaggaatctcaatgcctgccaggcgggctgccgtaaggatcgtggagccggccggagcggtaacggtcctgccattgattttaattgtaatatccgccatttgaatcttcctcctttatttcttgtagattgcgccgaaatggcatttctccatgcatgcgccgcacttgatacatttctcattatcaatgatatgcgggtttttaacggttccgataatggcgcctgccggacagttctttgcacagagcgtacagccgcggcatttttcacggtcgatgacgtatgagaggagtgccttacatacgcctgccgggcagcgtttctctttgatatgtgcttcgtattcgtcgcggaagaaatgcagggtggagagcaccggattcggagctgtctgtcccaggccgcagagagagttggtcttaacgtaatagcacagctcttccagcttatcgatatcctccattgtggcctgtccctttgtaatctttgtgaggatttccagcatacgtttcgtgccgatacggcagggcgtacactttccgcaggactcctccaccgtaaattccaggaagaatttggcgatgtctaccatacagtcgtcttcatcgaggacaatcaggccgccggagcccatcatagagccgatggagatcaggttgtcatagtcgatggggatatcaaaatgctctgccgggatacagccgccggaaggcccgccggtttgtgccgccttgaacttcttgccgcccgggatcccgccgccgatctcctccacgatttcacgcagagtcgttcccatcggaacctcgactagtcctgtattatgtattttgcctcccagagcgaataccttggtgccttttgatttttccgtgcccatggcgttaaaccattccgggccgtttaagattatctgcgggatattggcaagtgtttcaacattattgaggatcgatggtttcccaaacagtcctttctgtgccgggaacggagggcgcggtcttggctcgccccgttttccctcgatggaggtcatgagagccgtctcctcaccacagacaaaagctccggcgccgaggcgcagatcgatgtcaaatgaaaacccggttccgaagatatccttgcctaaaagctccatttcacgcgcctgttcaatggcaatcttaagtctctgcacggcgataggatactctgcgcggacatagataaagccctggctggcgccgatcgcgtagcctgcgatagccattgcctccagtacggcatggggatcgccttccagtacggaacggtccatgaatgcgccggggtctccttcgtcggcattgcaacagacatatttctggtcggcgtcgtttcctttggccagcttccatttaaggcctgtcgggaagcctgcgccgccgcgccctctaaggccgctgtccagaagcgtctgaatgacttcatcaggcgtcatctcggtcagtaccttgccaagagcctggtaaccgcctgttccgatatactcctcgataacttcaggattgatgacaccacagtttctgagtgctattctgtgctgctttttatagaaatcggtatccgccagagctttgataccggccggtgtgactgtctcgctgtagaggagcctggtgacaatacggccctttaataagtgttcggagacgatttccgggatatcctcattctttaccatggcatagaaggtggcatccgggtaaataatcatgatcggaccaagcgcacagaggccgtgacatcctgtctggacaacactgacctcctccgaaaggccgtttttatcgatttcagctttcaaggtttccataatctgcaggctgccggaagaagtacagccggttcctccgcagactaaaacgtgtgaacgatacatttggcttcctcctgtttatttgatatctgctgaatttaatgtgtatttttctaccgggtggccgccgattaaatgccgttccacaacctcagccgctttttccggattcattttaatataagttactttctctttgcccggctccatcacctcgacaatgggctcatactggcagagaccgatacatccggtctgggttacgataactttgccggtcagtcccttctcctgaaccagattggagagggtggtgagtacaggtcttgctccgctggcaatgccgcaggtggccattccgacaacaacacgggtggctccggtgccgctttcgcgcaagttaacctggttctgcatcctttcacggattgcttttaactcttcaaggcttttcatagattttcctccgttctgcatggacgcctagtaccaggcgccgccgtcagtttcaagtttgttttcggtcagatactccataatataggtagaaatctccggtgaatcaaagggaagatccccgagaatctcccggaactgtctggtgtcgagggtaaatgactttttgttatagcggtaggtgtaaacaaaatcagtatccggatgatagacaatcagagtatggatcgtcgaactgatatcgccgagaggcatccggtcaatatgggataaaacgaacgtggccgtcacgtcagtccctttgcccggaacagaggcgatggtaaaacttccgccggcgctctccgccgcatatttgaagaaggggacgccgagtcccaccttgcgggtcgtcctgctggtgaaaaaaggatccgttacctgctccacctgttctttcgtcattccgcatccgtcgtcgcagattgagatggtcagacggtcggatgaaaaatcggcatccacggtaatacggaccagtccggcgccggcccttgtggaattttcggccacatccagaatattcagtgataattccgtcatcatatttttatttcactttccggttttatatcccgctattcatattttgcaagaattgtgggcacatcgtctacggtcagtctgccgtaaacttcatcattaatcatcatgacaggggccagtccgcaggctccgacacagcggcaggaatccagtgagaatttaccgtcgggcgtacactcgccgttggtgatgccaagcagttcttcgagtttcttgaaaatatcaccggaaccttttacatagcaggcggtgccgagacagacagaaatccggtactggcctttcggctgcagggaaaactgtgaatagaatgtggcgactccatagattttttcaagagggatgccggtttcatcggaaatcatggtctggacttcgatgggaagataaccaaaaatctcctgtgcgtgctgaagaatcggcatcagggctccggctgtatcttttaattcgctgataaccctctttaaatcagcctcctgctctgcggtgcaggtaaagcatacgccttcttttttctgagacatgttttaacctcctcataaatactgaacttatgtaatagtttgctatattagcctgaatagttacagtttatcatgctattgcagaaaaatccacaatatttttgttgataattcccatttacgatgatatcctaaagacagacatatgttaaaataagacaattttgcaggaggatgaggaggaattattatgatgaccgtagaagacgtacgcagggtgctgggagcgcgggtcctcgtaggggagcagtacctggatcgggaagtcagaactgcctgcggcgccgatatgatgagtgatgttctggccttttcaaaggatcattccattcttttgacagggctgtgcaacccgcaggtaatcaggacggccgagatgcttgatattgtctgtgtcatctttgtccggggtaagaaaccggatcagaagatcctggacatggccagagagaccggacttgttatcatggagacgggacacaggatgttttctgcctgcggcatgctttatgaagcaggcctgcggggaggtgcaatctgatggatgatgtgattacactgcagtacaaggtttctcccgatgattttacaagggcgggggaagccagcagcgacgtaaagaataaattaaaacagcttgggattagtcccacagcgattagaaaggtttcgattgccatgtacgagggagagattaatatggtcatccatgccagaggcggggaaatcacggtggacgtatcaccggagaccataaagatggttctggccgacgtggggccgggtatccctgatatcgaactcgcaatgaaagaaggatattccaccgcgcctgacgagatcaggagcctgggctttggagccggcatggggctttccaatatgaaaaaatattctgattatatggatatccagacagagctgggagttggaacgacgataacgatgattgtcaatgttgcataaaacagtctgtccgggtgaggagggaaggctatggataaattttaccattccgttcgtctggacccggagctttgcaagggatgcattaattgcatcaagcgatgccccacccaggcaattcgggtgagaaacagaaaggcgcagataaacagcaagttttgtatcgactgcggggaatgcattcgggtatgtccgcatcatgcgaagctggcactctacgatccgctggattcattacagcattatgattacacggtagcgcttccggcgccgtcactgtacagccagtttaacaatctggatgatgtgaatatcgtgctgaacggcctgattctgatgggatttgacgatgtctttgaggtgagcgccgctgccgagatggtttcggaggccaccagggaatacatagcggccaactactcgggaacgccgtttatcagtacggcctgtccgtcggtagtgcgcctgatccgggtgaagtttcctaatttaatatcgaatctgcttccgttaaaaccgccgatcgaggtggcggcccagatggccgtgaaaaaggcgatggaacagacgggactgcctagggagaagataggaatcttctttatttcaccgtgcccgtcgaaagtaacctatgtcaagtccccgcttgggaccgacagaagcgaggtggaccgggtacttgcgattaaggatgtatatccgcagctgatatcctatatgcagaccgtggatcccaaggcgcccgacatgtcggaatcgggcaaaatcggggttggctggggccgcagaagcggcgaggccggaggcctgtttacggagagctatctggcggccgacggaattgagaacgtcatccgtgtgctggaggatatggaggatcagaaattttccaatctgaaattcgttgagttaaacgcctgcaacgggggctgcgtcggaggcgtgctgacggttgagaacccttacgttgcggaggtaaagctaaaatggctccacaaatatatgccggtttccaagagccatctggacgaagaggccaggggctgtgtaaaatggacggaacctgtggaatttgaacctgtattcaatctggggaacacgctgacagagagtttttccagattcaaccaggtggagcggatctgtaaaaagctgccgggcttagactgcggctcctgtggggcgccgacctgtaaagcgcttgcagaggacatcgtgcgcggcgaggcggatgagaaggactgcatctattacctcagggaaaatctgcacaaactgacggaggaagtgacgatcatggcggactatctgatagacggtgagaatttcggtgatgaggccgtctatgtgctgcgtgagtgcgtacataaaattgccgatgagatgtcacggcttgagaagaataccaggaggaccggggatgaccttaaacaatctgattgagaagctgacggccggagggcagttcaaaatcttgaataaggggacggacgtggaacgcgaagtgacgggaacttattgctgtgatctcctgagcattgcgatgagccgcgcgccggaggggtgcgcctgggtgacggtgatgggaaatatcaacactctggccgtggccgccctgacagataccgcctgcattattctggcggagggtgtcacccttgacgaaccggccgcacaaaaggcgggggcgcaggatataacagtgctgcgcacagaacagcccgtattcgagagcgctttggagatacaccgggctctccagacagaggagtctgcaaaagactgaagaaaagaactgccggggccggagggagaaggttaaatgataaatctgttttatgatctgcatatccattcctgtctgtccccctgcggcagtgacgatatgacgccgtataacatcgccggaatggctgccttaaaggggctggacgtgatagccgttacggatcataattcctgtaagaactgtccggccgtgctggctgcggcaaaggaatacggaatccttgcggttcccggaatggagattaacacatccgaggaggtacacgccgtatgcctgtttaaatccctggaaaaggcgatggagtttgatgcatatgtctatggacggcttttgccggtgaaaaacagggaggatatattcggaaagcaggaaatttatgattgcagtgatcagatctgcggccatgtggagaaccttcttatcagcagtaccgatatctccttcagcggtttatgggaactggtcaggacgtatgacggagtcatgtttcccgcccatatagacaaggcatcgaacagcctgatttataatcttggctttattccggaggacagcctgtttcgtacggcggagattgcggatatgaaacaataccatgctctgaaaaagagcaatccctatctggagcattgcaggattatcagcgattcggacgcccattatctggaggacattcatgaaccgcggctgtcaatagcagtggaggagagaacggccgctgcggtggtggaggcgctgcttgccggtatttaaaggaggaaacgtatgggaaaggcgtctgccgcccgaaagaggctttatatcattgtatcagccattctgtttagcctgacgacaccggttccggcgtcggcacagggagcggaaaataaccaggaggaaagctggaatattgccgtgttcggtgttcactcaccgactgaaacgaaaaaagaagagagtctggaatttgccgcagtagtggaaattgacagagagagcctggaacttaaaacggaatatataccggtgagagacggtgcatatgatgtacagaacaaggagagcggctatccggatctgggaatacgctatgacgattatgtagcttttaactggaaagacctggtggatgcaattaatatactgggaggagtggaaaccgtgatcagtgatgaggaatatgtctatatcaatgcctatgtaacccagaccgtagcggaaaccgggatagcgtccacccggatcagcaaggcggggctaaggtatatcgacggcgttcaggctgtggcttacagccgcatgaaattatcggaaaatgacgcagagcaggtgaaaaggcagggaaagatcctgtcactgacatggaacagactgacgcatacagatatccggtctctgtatcgttttgtccgcaatatcctgcccggaattaagaccagccttgatggggatgaactgacgtatctgtataaaaacggcagagagtggggactggactgagaataaattttgaaactacttacaatacatttcaaggtgtggggtaaatagcaatgcgaaaatttgaatggctagtagaggcagtaactggacactgctcctgtggagaaaaaccctaagtcaaaaaggaatttagcgtgtccagataatggttatgtaactttcaaattaacaatgatagaagattaagcctatctcaatatgcgtggttttacccgacggataggcgtcctttaatgttgacattacgaaatgaatgcagtaaaatacagctgtaaatttaataagaaaaggtgatgttagtccggcgtatcagatgttacacaatcagtaacgtgggtatgactggaaaagagtagataaaatcaatccaataggcaaagaaaaagctgtatcaacagcttatttttagtacctaatgtttgattttattttactctttaactaattcttcatcttttgaaagattagccgtagagtaaagtctacggctttttcttttgcacaggaaaggagaaaaaaatgaatagcagctttataacatctttgaggaaaccccctatctacaccaaatcaatggttgagttttggaatgatgaatatatctcagaacaaatgctcaaagcgcacttagaccccgaatttgacggggcaagtagaaaatcggactttattgaaaaatctgttgcatggataacagaacagatcccgcctgccgattatcctttgcttcttgatatcgggtgcggtccaggaatatatgctgaaatgtttacccaaaaggggtatcaagttaccggagtggatttttcaaagcgttctatagactatgcacaacaatcagctttcagcaagaagctaaatatttcatacgtgtatcaaaattatttagaaatggatttgagcaaaagttttgatttttgtaccatgatatattgtgattacggtgcactatcgactaaagacagacaagtaattatgaaaaagatttatcatcatcttaaacccggcggaaaattgttattagatgtattttccatgacaaagttttatgattttcaagaacaacaagtttgggaagtatgccctgatggcggcttttggcgttctgacgaatacatggtgctaagtggattttataaatatttagacaatgtaactctggacttaatatcaattatttcaaaaaaagaaataaccccatattatttgtggaatacatatttctcaaaagaaacattaatacaagaagccgaaagcattggctttaaaatgtgtgggctgtttggtgatgttgcaggacgtatttatcagcctgaaagtgatacaatcgcagtaattttggaaaaataacctttaggggcagatcgtcatagtgaacctttaacagcagaattcaaatggacgattccccggactatattaaaagtgcagaggaaaaaggatttgaagtgaacggcgaatcatcagcaatacaatcgtgatggtgattgccgtcttgacaggtgttgaagttatgatggaggatgcctcttgcaacagttcagccatgatgtattccgcgaggtgttttcgctgctttttgcgaaaatcccgagttatgtggagcgtaacggcgcccagactggttgagggttgacatccgccggtgattatgataaattaatcattagcataaatgcagagaagaggaatagtaggctgaaagtcatatcagagagccgccggagggtgcgaggcggttatgaatctgtcagttgaactcgccttggagcagcctgttgaagagaagaccggatgtatttttgaaagtatatctgttcttgtgtaggcagagccggaatcccccgttatgggagctgaaagagcataccgaacgtctcatgccctcatccggggataagagcatacacggtatgaaatagagtggtaccgcgcagtatagaatatatgcctgcgtctctatggaaacatatagaggcgcaggctttttaatttatcggaaagtgcgatttcctgcgctcttgatattttatgggaaattaaatcaattcaggaggaagaagatgtcacagtacaatcataccgccattgagaagaaatggcgcagcaattgggaaaagaacccgatcaatgtaaatgacggaaaaaaggagaaatactattgtcttgatatgttcccttatccgtcgggaagcggacttcatgtgggacactggagaggatacgtcatctcagacgtatggagccgttaccagttattaaaaggtaaatacgtgattcatccgatgggctgggatgcattcggccttccggcggaaaactatgcgattaagatgggcgtccatccggcgatctccacagcagaaaatgtgaagaatatcaaacgtcagattggcgagattgcggcaatctacgactgggatatggaggttaacaccacggatcccggcttctataaatggacccagtggattttcgtccagatgtttaaaaagggactggcctatgagaaggaatttccaattaactggtgtccgtcctgtaaaacaggtcttgccaatgaggaagtggttaacggctgctgtgagcgctgcggaaccacggttaccaagaagaatctccgccagtggatgcttaagattacggcttatgcggagcgccttttaaatgatttagacaaactggactggccggagaaggttaaaaagatgcagaccgactggatcggaaaatcctacggtgcggaagtagacttcccggttgaaggaagagacgaaaagattacggtatatacgacaaggcctgatacgctttacggagccaccttcatggtgctggcgccggagcacagcctggcaaagagcctggcaacggatgagaccagggaagcagtggagaaatatatcttcgacgcgtctatgaagtccaatgtggatcgtcttcaggataaggagaagacaggcgtctttacaggctcctatgccgtcaatccgttaaacggggctaagacaccgatctggctctccgactatgtactggccgactatggtacgggcgcaatcatgtgcgtaccggctcacgatgaccgtgactttgaatttgctaaaaaattcaacattccgattatccaggtaatcgccaaggatggaaaagaaatcgaggatatgatggaggcttacactgaggccagcggaatcatgattaattccggcgagtggaatggaatggagtcctccgtactcaagcaggaagctccggctatgattgaggagcgcggcctgggcaagaagacggtgaattataagctgcgtgactgggtattctcccgccagcgttactggggcgagccgatcccgatcatccactgtccgaactgcggcaatgttccggttccggaagaccagcttcctctggaacttccgaaagtggagagctaccagccgaccggtacgggtgaatcaccgctggcaggtattgacgagtgggttaacacaacatgtccgtgctgcggcgctccggctaagagagagacgaatacgatgccccagtgggccggttcttcctggtatttcctccgctatgtggacagcaagaataatgaagaactcgtttccagggagaaagcagataaatatctgccggttgatatgtatatcggcggcgtagagcatgcggtgcttcaccttctttactcccgtttctatacgaaatttttgtgtgacattggtgccattgattttgacgagccgttcaagaagctgtttaatcagggtatgattaccggcaaaaacggcatcaagatgagcaagtccaagggcaatgtggtttcaccggatgatctggtacgcgattacggctgtgattccctgcgtctttacgagttattcgtgggaccgccggaactggatgcagagtgggacgacagggggatcgagggcgtatcccgtttcctgaaccgtttctacaatctggttatggataataaggacaaagaggtcgaggcaacaaaggaaatgattaagatccgccataagctggtgttcgatatcgaacagagatttgagcagttcagcctgaatacggttatttccggatttatggagtataacaataagctgatcgatctggctaaaaaagaaggcggaatagacagggagacgctgagaacctttacggtgctgttagctccgtttgcacctcatctcggtgaagagctgtggcaggcgctgggcggcacggacagtgtattccatgccgagtggccggaatgtgatccggagaagatgaaggacgatgagaaagagatagccgttcagatcaacggcaagacgagagccgttgtaacacttcctgctgatgtgtcgaaagaggacgccattgcagccggtaaagaggcggtgaaggataagctgaccgggaatgtggtgaaagagatttacgttccgggcagaattgtcaatattgttatgaaataacaaccatatagaaaagtaaaagagcattgcttccggcatgaaattaaattgattttgtgccgggagaggctctctttttttgcaattcaacgtgaaatcgagattttttactgaatctatgctaaaatacgggagaaagggcaatggagaagctgccgtggcgaaaacgattcgccagtgaaccggcccggtgagaaagccggcaattgcaagaaaatcgtaattggaaaataatagcgctttgtgctatgattataaaaaatgaagaaacaggaaaggactgacagaacatggggcatatcacatcaaaagatgcctacaaaagcctggaggagcggatcaactggtttacccagggcgctccggcatcagatacgttatataaaatactacaggtgcttttcaccgagaaagaggcaaaggtcatggccatgcttccggtgaggccatttactttaaagaaagcggcgcatatctggaatacctccgaggcaaaagcggagaaggtactcgatcacctctgtgaaaaagcgctgctggtggactcctggcataacggagtcaggaaatttgtcatccccccgcccatggccggattttttgagtttgcgctgatgcggaccaggggagatatcgatcagaagtatctgagtgaactttactaccagtatatgaatgtggaagaggactttgtcaaggatcttttctacgcaaccgagacgaagctgggacgtgtattcgtccaggaaccggttctcggtaatgagaatatgagccatatcctggattatgagagagccagccacattgtggaggaagccgactatatcggactgggactctgctactgccgtcataaagcggctcatgcgggccacccatgtgagaccggcgcccctctcgacgtctgtctgacctttggcaatgttgcccgttccctggctgagcatgggggacatgcgcggctgatctcgagggaggaagccatggatgcactggagcgatcctacggcgccaacctggtacagattggagagaatgtaagggaatatccggcctttatctgcaactgctgcggctgctgctgcgaggccctgcaggcggcaaggcgtttcgcgccgatgcagccggtggcgacaacgaattatatcccttcagttaatatggaaacctgcatcggctgcggaaaatgtgccaaggtatgtccggtgctggcgatcaggatggaggaagaaaatccgtccggagaaggggagaagacaggcaggaggaaagctgtggtagataaagatatctgtcttggctgcggcgtctgcgtcagaaactgtccggtctcggcaatccggcttgagaagcggccggtacagattattaccccggtcaacagcacccaccgttttgtcctgcaggccatcgaaaagggaacgctgcagaacctgatatttgataatgaggcatttgccaaccacagggctctggctgctgttttcggaacaattttaaaacttccgccaatcaagcaggccatggcgagcagacaatttaagtccatctatctggacaagctgctttcggcccagattgagaagcagaaggcagaacagaagtaattaacgcggaagataagggagggacagatgcccagactattaatcaaacagagagtattttcctggaccgacacttacgatgtatatggggaggacgaaactccgaaatactttgtcaaagcggagtttctgtcactgacccatcagatccatgtatacgacagccgtacggacagagaagtcggcgcggtgagggagaagctgttcagcctgatgccacggttcgaaatagagttggacggagagccgaagggacatattgaaaagcgtttcacactgtttcgtccaaaatatgagatagattttaacggctggtatgcagagggggattttctgggatggaattacgatatatacgaagaatgttccgccgtgatgcatatagagaaggaaatcctgcactggggggatacgtatgtacttgattaccagaatccggaggacgaacttttgggactgatgcttgttatcgccatcgatgcggctaattgcagcaacggatagtgcagacagaatgactgaagaaaggaatttgataagatggcagagaaatttggcagaaagctgaaaaaatataacagagccggaaccgcattactggcagggattcttcttgcatctgtgaatgtacggaccgcagccgcgagtaccctggcccgcggtccggcctgggagagtgaacagatgaggcttggactgttgacggatgaggcggccggaaataccgtttttaacggtgatgtcaacacattgaaggcagcggcagaggcatcccagttaattgtcgctgtgggaaatgaggcggatcccgcgcaggggacgctgacctggtatgtcagaaatcaggaagggaagctgataccggctttttcagtaccggcggtcagcgggatgaacggcatatcagccgataagcgggaaggagataagaagactccgtccggaatctattcatttaccatggcctttgggatgaaagacaatcccggcagcattctcccctatcacaaggtggtaaacggagatcattttgtggacgacagcggcagcaggtactataaccgccttgtcaatgaatcccaggtgcagaaggactggaattcttcggagaacctgatacgccaggcaccgcattacaattacgccctggttctgaactataatgatacgtatgttccgggaaaaggctcagccatattcctgcattgccctaagactgctaacaatacaggcacatccggctgcatcagtattccggaagaatatatgaagctgctggtgcagtccgttgatcagaatacgaaaatcattgtagtgcagaatgaaaaagagctggcctcctattagaagcagaagggatagcgtaaagcatataaatccggcagccatgcaggccattccattggggaggtactgcaccggctgttcggattttttcatttaacaggatagttctcctgttaaatgaaaaccgctccgaggaggatcgcactgcttcggcagaaaatctcgtcatttggcggcctgcctaaagaatctatacaggtaaaaattaagaatgagtaagagaaaagcaaaaaaagccctggtaaaatccggtataataaaaagaggaagaggaggagtattttatgaaaaaaagaacatgtaacaaaacggctgccctgtgcggcctgatactgctcgcgatatcctctgcggttctgggaggatgcggcaaaagtgaaatcctggcgccggatgcaaagacggtcctgccatcctatccggaatcgatagaccaggaaaaggattgggataagtggaggaaaaatcaggacgagaacgaggtgccacagtcatttatagagagtcagtccggctttacattcacgacggcgagagagcttctgaccggccgggaggaaaatctggtctactccccggcgagcctttattacgccttgtctctggcggcatcgggaacacggggagaaacggccggggagctgtaccggtttctgggagtggaggatcccgacagcgccgctgagtatgcggggaggttctaccggattttatattgcgacagttccatcagccagatgcggatggcaacctccctttgggtggatcaaagcatgagcctgaaggaagaatttactaagacggcagccgcccggtattatgcatccctgcatacggtggatttctccgatgaaaaaaccggaaaagagatggggaaatgggtaaaggaaaatacaaaagggacgattgtgccggagatcagggttgaagcccagcagcttatgcatcttatgaatacggtttatttttacgatgaatggatcgaccggtttaatcagtcgtccacaaagaaaggcgcttttcatctggcggacggcaccacagaggagacagattttatgaacgctacatacggctcccataattacagaaatggggacggatttgtcagttccagtctgggccttaaggagaacggctctatggtttttgtgctgccggatgagggcgtcccggtggacagcctttttgacacgccggaccggttgaaggaggttctggagggcggagaaagccatatgggcgaggtggttttccaggttcccaagtttacggccgatacacattccgatatcagagaggtgatgataaagctgggtataaccggaatcttcgaggatggagatttctcaggaatgacagataataaagggatttatatctcctccatcacccaggacggccatattgccatcgatgaaaaaggggtggaggcatcggcatttaccgatattacttacgcaggagcggcgctccctgaaggaagggcggacctgatactggatcgtccgttcctgtatggaattgagaaaaacggcgtatggctttttatcggagtctgtgataatccgtaggatagagtaccagagcgtatttaaaaattcattcccgccatctgcaggccccactacgcagcgctcattcagaccaaatctcccacaaagtgtgacgtaccgctggcagaaagcaattttcaaacatgttctagcgattgggagacaggcggaaacaatttaaaaagttctgcctaagctgttccccgacagcttccggcagagcctgcctgatttctgcaatctgctgaagtgtaaaggaaagggatgccgggactgagagggatgccgcctttgcaggatgagtgcggaggttttccggagcttcttcgtatgcccatttgacagcgcccattccgtccgtctcgattaagatccgatcagcaggaagggcggcagccagatttctcacggccggattccaccagacgtcggggccgatagaaaaataacagtcaagctccagaaaagactttggaaaaacagggtcggagtaccagtggacaaggtaggtattcggataacctgcaatcagggaggcaatcctttgttcctggcccttcgtgtgcagaataaccggtttgtccagttgggctgcgacggccaattgttcggtaaacaccttctcctggacagccagagggacgttgcaccagacgctgtccattccgatttcaccgatgacgggacattctgaaaaataagaaagcatttccgataatgaatactgaccggcataccatggatgaaggccgtaggtgggaattataatattcttatattccggccgggaggccaggccgtagagctttacggcttcccttggattgtctgcgcacaggagggagcggacgccttttattctgcgctcttcaagttctttactgctgccgatatgggcatgggaatcacataaggtcatttttcttcctttccggtgcattagattcagacccggccggtcatgatttccgaatggattttctgtctcagggcgccctggttatagagccagtctctgttccgaaccctgtccgggatttcaatttcgcaggtgatatgggccggagcctggttcaggattaaaatcctgtctgagagatagagcgcttcatccatatcatgggtgaccaggagtacggtccggttcagcctggcccgcatactgatcagccagtcctgcatatcgccccttgttataacatccagagcgccgaagggctcatccagaagaaggatgtcggccttacacagggctgtccgcagaaatgcggcgcgctggcgcattccgccggatagggaggaaggatattttgtttcatatccctccagcccaaatgcggggaaattcttagatgcctcccgcctcatttcttccatggaaccatggatctgaccgtagaggcagacattatccaggatagtcttccagggaaacagcagatcattctgcggcatataagcaaaatgctccgacagtccggtaacaggctgcccatccaccgtaatccgtccggtctcagcctggatgactccggtcagaagcttcaggattgtggactttccacagccggacggtcccagcaggctgacaaattctccttctttaatagaaaaatccagattttcaaacagtttcttattatcatatgaaaacgataatcctgatacttccaacttcatcatcggttccagtcctttctttattccggaagaaattcgttcgtatagcagtcggatgcagggataagcttgtcaattaccccgtattccatcataaattctgtatatctgtcccaaacctcatccttcataacaccccatctgtccgcatcctccatatacttatcggcaagatagttctgtgatatttccagcatctcaagaggataatcaggagcatatctctggaggatggcagcgcctgtctccggattctcaattgcgtattgatatcctttctctgttgcggcaagaaatttttttaccaattccggtttgtttttcagtgtatcgtcggaggcgataatcacaggagtatagtagtcgagacgctcgtcaagctcccttaccggcatatagtcgattggaaaatcattcatctggcattttacattatcccaggcctcataaaaccacatgatatccgccttatcctttaatgcctcaaaaccggaaccgtcggagattaccatgttaagttttgaaaagtctgcgccatcctttgtcataacggcgttcaaaacagcttcttctccggggccgccccatccggcgtacgttttaccctcaaaatcttttggggattttattcctttaccctcgtaggtggcgaaaccggaggtgttgtgctggatgatggcagcgattgctttaattgggagtggatctgccgaagtgcgggctatcgtgacatcttcctgatagctaattccgaaatcaccttttccgactgccacgagagttgcggtggctccttccgtaggttcgatgatattgacttccagtccttcttcggcataatatccctgatacagggctacaaacatgccggtatgattggtgttggccacatagtctaaaatgacggttacggtttcaggtccgtctgtcccctctgccggtaaaacgccctgggaatctgtcccggatgctccggtttcttcggaggcagctgcgtcggcggacggggcggcagttggctgggcggctgactccggagctttggaagaccgggaacagcccgtcagtgcgccggaaaggacagcggtggacaacaggattgctagcattttctttttcataattattctccttaattgtatattaattattactattcatggcctgtatcccgcgaggtgtttttgtgcatatattgcgcgaaaatcccgggttacacggcgtgaaactgcatttttcagcaggtccgtgaatagtgatattaatttttggtgtgcaggtagggcagggcggcaagctggtagaggcggatgagcccattcatacacaggctcaggaaaatgataaccagaacacaggcgaataccttgtccagcatgtaactgtttttgactctcagcaggtagtagcccagtcctttctgggagccgatccactctccgacaacagcgccgctgatactgtaggtggccgaaaccttcaggccggacagcagagagggaacggcggccgggattttaacgaggcggtatgttttccatctgcctgccccataggagcggaccagatggacatactcctcatccacctgggcgagcccgtctgagaagctgactgcgattgggaaaaagcacatcaggacaaccgtcagaattttcggggcaaccccaaaacccatataaataatgaggattggggccagcacgatcatgggaaccgtctgggtgaccacaagaaccgggtatagtccctgcttgatgatgggaaaacagtccatcacgatgccgagaagcagagccagtatcagggaaattacaataccggacagagcctctgagacagtgactaccgcatggccgcccaaggtgtcgagttccgaaaaaagtgttctgattacctgtaccggtgatggaagcacatacaaaggaatatggaaaaatcctacggccgcttcccaaatcagcagcaggataatgatgaaaagggccggtattatattttgacagtattttttcatgaatgactcccccgttttaaatggtaaagtaaaggtatatttcacaggataagaatgactcccgcgtggagagctttcctgttaaataaacaaaaatcccgccggataatggcgggatatcaaggttcagtatttcacgtccctacgttggcattatccaaatcaggtaaagggtcgaaattaacaatttcctctcagccagtttacaagctcccctgtttctttttttactagctgattgtagcatgaaagtcggaggaaatcaatcttttttgtcattttggaccggactgtggtaacagttcagacatgatgtattccgcgaggtgttttcgctgttttttgcgaaaatcccgagatatgcggcgcgaaacggcgttttctgccgtttctgtgcatcatttgttgcagtttggccggaggctgaactgtaacggactgtgccagtataagcaggatggaatcataagcgccaggttctgactatatgaatccatttataacaatttataacaatgtatgaaagatatataataacggtatctcgtgagacaggtttaaaaatgacaaaggctgttattgcggccgcgcgcgctgtatcggtaaagaatggagaacggcgacccgctggcaaggcgtgagatatatgtaacctgtaaaaagggccgctacaagacaaaagcgatagaagtattcctgtctctttgcggaatcagccttgaaaaaaatgatgtgtgaaaaatcctgattattacttgtattttgcatccggtggaaatataatgtatttacatagttagaaatatatggaaatcaggaggtaacaaaaatggaattaaaattttatgtctgtgagcattgtgggaatatcatcacgtatgtgcgcaacagcggagtaccggttatgtgctgcggccagaagatgacggagcttgtgccgggaaccagcgacggggctgttgaaaaacacgtaccggcagttgagacagacggcagggcggtaacggttaaggttggagaagtagagcatcctatgatggagcagcattatattcagtggattgccctggagacaaaagaaggagtacagattaagcatcttacaccggagatgaagcctgtggctgaatttgcactgagtgcgaacgatgaagctgtggcagcatatgaattctgcaatcttcacggcctctggaagaaagagatctaatatgacattgggagcagggaggccggttgcgttttcctgctttctttatagatgggggtgacctgtacgcagagcgtgcaggttatcgtcatatgcggcggccagtgcgcaaagggaggaaaacggatgaaaacaatagggatgatcggcggaatgagctgggagagtacggttctctactatcagatcataaacgagacggtgggaaaagagctgggtgggctccattctgcaaaaatcctgctgtacagcgtagatttcgatgaaatagagaaataccaggccggcggcgaatgggagaaggcaggggaggtcttatcggaagcggcggtaaacctggaaaaagccggggctgattatcttgttatctgtacgaacactatgcataaagttgtgccccagatacagacgcatattcagattcccattatccatatcgcggaggcaacggcagatgtgctgaaggagagccggatccggaaggtggctctgcttggaacaaagtatacgatgacccaggatttttacaagaaaaaactgaccgatgctggaattgaggtactcattccggagcagccggatattgaaacggttaataacgtgatttttaaagagctgtgccgcggtgtcgtttcagaaaattcgaaacagcagtatcttgcgataattgataagcttgccgccgaaggagcccagggggtaatattgggctgtacggaaattggaatgatgatcagccgggaagatacacagcttcctgtttttgatacgacaaggatccatgccgaaaaggccgcatacctgtccattcaggactgaggccccggtcagagccggatattgcgctgagtgaaccgtaacagaggccgtgtgacaggagcggccggacagttacaggcgctcagccgcaatatccgtttttttaattccgggaggaatttatctgcgtccgccgcccattctctttgagagggtgcgaagtgtctcaacctgttttttctgtgccgggttcatgcccgatgtcagaatcgatacgatgagttcagtttcctgatcattgaaatccaaaccgttattgccggcggccatgctcatcagcagcggcattaatttgtccttaggcgtttttcctgccttatcggccagctccgtaagatattttagctttttttcatccatgcctttcagacggggatcctgtctccagttttcattcataatttaagttcctttccggtgttttgatttatgagaactgctgaaacgtctgcatcagcatttgcgctgtttccagccgtgactgttgctcaggcggcagcatgttcttaatctggtcgatgggaaaacggaaatgatcgtttcggcttctgttctgggaagaagcgtttccggaatccctgtcatggctgtgttcattctgactgcgttcctgattatgtacctgttcctggcgcggttcctgccgtggaatctcctgatccggaacgtccatgctgtccatataggactggtatagctgggagccctgtaggaaattgatgataagatcaatgaaatcctgttcggcttctgttccgtacggcttcatcgcattcagcatatccagcggggaggccggtgcatcttcttccagcgaacaaatccccagttctccttcttctttttttccaaacagctgaacggtgcgttccagttcaccgattttgacaagcagggaaaagatacgctgttcctgtatattgatgtagggaagagccgctttgatcatctgaagatgaggcgcggccgtcagataatccagctctgtcatttttaaagtctgttcattgctcatgggacaatacctcttaattccttgcctaaatatatgcacgaaaagaatagaacataccgacgctttggaaattaccgcatatactaaagtacgatgaaaattacaggaggaaagtgggaatgagcacccgtttaataatagaaggcaacagcgtatacgaaatcgatgaagactgccttgcctgcagtgaaaaactggagaaggagaaaaaagaacccgttaaaagacctggtgaaaggatagagcaccggggaggacgcagggaaaaatagagattgaattaggcaggtggggactccgccggtacggccggcggccgggggtgtatatgagtctttcgtcccgggggaagattgtcgcggtggggggctgcgggcgaagataaagtctgcggagcacactcccgctctgtgaaatgcattgcgctgctaagctcggcaagacctcgctaatcagcgatggatttaggcggcatccgcagcaattcattccggccggattcccccttcacgaccaacctcccacggggacggaagactcagccggccccctcaccacaccggcccccggacgcgtcctccgttctcaacgaaaatcttgttcttcatacggctctatggtaaaatatctgtaaaccatatgcgccggcaaacagggtgagctgcgggaatggacagtccatatacggaggataaatatgtgattcattataagaactatgttaaaccaaaggatttagaagaggcatttgcactgaatgccggaaaatcagcagtgatagcagggggattctgctttctgagactgcagcaaaagaatatcggcacgctcctggacctcaaggagctgctttcggatcagatagaggagacgggggacggattccggatcggagccatggtttccctgagacagatagaactgcatgagggattgaaccgctatacggcgggcgctgcagcagattgtacacgccacatagtcgggacgcagttccgcaactgcgctacggtgggaggcagtattttcggcaggtttggtttttccgatctgctgacctgttttcttgtcatggattcatgggtggagctatataaaggtggacaagttccactggccgaatttgctgagatgaagccggacggggatattatgaccgcactgctcataaagaaaacggggatgaacatggcctatgagatgatgcgcaacgaggcggttgattttccggtgctttctgctgctgcggctgaagacggcgcgggaaatacgcggatagccgtcggcgcaaggccgtccagagccgggcttgtgacctgggaaggtcagctgtccgcactggacgcaaaggagagacaggagcaagccgccaggcttgcagatacatttaactatggaagcaatatgagaggcagcgcggagtacagaaggtatctggcgggcgtccttttggacagggcggctgcgcgcattgcggcgcagaaaatgaaccgggaggaaaagacgagatgaatctgacatgcagtattaataacaagacggtgagccgggaagtggctcctgatatgatgcttcttgactttctgcgttcccagggctgctacagcgtcaaatgcggctgtgaaacaacgaactgcggactctgtaccgtctggatgaatggaaagccggtgctaagctgcgctgtccctgcgcttcgtgccgggggatgtgagataacgaccttggaaggcgtgagggaagaggcggaagaatttggacggtttctggcaggtgaaggcgcggaacagtgcggattttgcagtcccggattcattatgaatgtgctggcgatgaagagagagctttcaaatccggacgatagggagattcgcgaatatctggccggcaacctctgccggtgcaccggatatgcagggcagatgcgcgctgtcagaaaatacctcgaagccgtcggaagacaggaggcagaaaaacaggagacagagaaacaggagacagagaaacaggaggcgcagaaatcatgaaccgagaaaagaatgtgaaccgcgctgtgatgaaaaaggatgccatggctcttgtgacgggggcgccggtttatacggatgatctggcgccgaaagactgcctggtggtaaaagtcctgcgaagcccccatgcccatgcgctggttaagacaatagatacaaaacgggcgtctgccgtccccggcattgcatgtgtgctgacatgggaggattccccggcgtgccgttttacccaggcagggcagacctatcctgaacccagtccctatgacaggagaattattgaccggagactgcgttttgtcggagatgtggttgccattgtggccggcgatacggaacaagccgtggatcgggcattaaaattaataaaaacagagtatgaggtgcttaagccggttctggatttcagaaaggcaaaggacaaccctgtactggtacatccggaggaagactggaagtccctctgtccggtgggggcggacaataaaagaaacctctgttccagcggaagcgaatcggatggcgatgtggaagccgttttaaaagactgtgatctggtgattgagaggacataccatacaaaagccgataaccagaccatgatggaaacattccgggcatttacgtatctggatgcatttggcaggctgaatgtggtggcttctacccagatccctttccacataagaagaatcctggcgaatgcccttggcataccgaaatctgccgtccgcgtcgttaagccgagaatcggagggggattcggagcgaaacagaccggggtggcggaaatctatccggccatcgtcacgatgaagaccggacgccctgctaaaatgatatatacaagatatgagtccatgatagccgcctcgccccgccatgaaatggaggtgacggtccggatgggtctgagtaaagagggaaaagtccgggctgtggatatgtatactctgtccaacacgggagcttacggcgagcatggaccaaccacggtcggattgagcggccataaggcaataccgatatacacgccggaggcattccggtttacctatgatgtagtctacacgaattaccagtcctccggggcatacaggggatacggcgccacccaggggctgtttgccgtggagacggctttaaatgaggcggctgcgcttctgggtatcgatccgctggaaatcagaaggaagaatttcctccgggaaagacagattatgccggcttattacaatgaacggctggagagctgccatgtcagccagtgcatggaaaaagccagggccatgatggattgggataaaaagtatccgtttaaggatatgggaaacggcaaggtgcgcggcgtcggtgtcggaatctctatgcagggctccggaataccctgtgtagatgtgggtaccgtcacgatacgcctgagcgatgagggccactataatatgatgatcggggcgaccgatatgggaaccggctgtgatacgattctttcccagatggctgctgactgtatggattgtgatgtgaaggatatcgtggtgtcaggcgttgataccgacgtatcaccctacgattccggttcctatgcatccagcactacctatgtgacgggaatggccgttgtgaaggcatgcagggagctgcgggagaagattatcgcacagggggcggagcttttgggcatacctgcaaaaacagcagactttgacggcgcctgtgtttatgccgcgaacgaagataacgcaaatgatgggtcagcaagtatttcactcaaggatatatccacaaaacgtatgtgcggttcgggcctggctctggaagccacggtttcccattcatcccctacctctccgcctccgttcatgtgtggaatggcggaagttgaggtggatctccaaaccggggaaattgagctccttgagtataaagcggccgttgactgcggtacggttatcaatccgaatctggcgagaatccaggcggagggcggcatcgtccagggaatcggcatggcgctttttgaggatataaattatacggataagggaagactgaaagagaactcctttatgcagtataagataccggcccgagtggagataccggatctggaggtggaatttgactccagctacgagccaagcggtccgttcggcgcgaagtcggtgggtgaggtcgttatgaatacgccgcttccggccatcgtacaggcggtttatcatgctacgggtctttggttccgggaacttcctattacgccggaaaaagtgataagggggctgggtaaactgcgatgatacatgtgatactgctggcagccggatattccagccgcttcggcagcaataagctgctgcatatagttgacggcactcccatgtaccggcatgcgctggaaactgcagagcagttcaggcagttgtactgttgtgagccggtcaggctgattttcgtgacggcttatgatgatatcggaaaacaactcagggagaaggacgggttctgcctgttcggggctgccaaggccgggaacacggcaggccgggatctggtcgtgatgaacccgaacagcgggcttggcatatcccactcgattgccctgggggtgaaggctgcaggcgcggaccggtttcgggaagatgacagcctgatgtttatggtctgcgatcagccgtggctgacgccgggcgatctcttaaacctggcagcctgttttaaaaggtcgggaaaatcaatcggctgtatggcatatggagaacagacgggaaaccccgtcctgttttcggccgtctaccgggaggaactgcttgggctcaggggagacaccggcggaaaggccattgtcaggcggcaccctaaggaggtatgtctctgtccggtatcaaatcccagggcgctggaggatatggatgaattgcagtaacagttcatgctgtccgaactgttacgaaatgccgtaacagtaacggtaaaaattgacaatgacattgacagggaagaagatgagtgagactgtatgaatctctataagataatgctggtggatgatgaggaagaggtaagaaagagtattataaataagattgactgggcggatgccggatttgaagtaatcggggatgcggagaacggcaaggatgccctggaaaagattgaacagaatgagccggatgtggttctgaccgatattaagatgccgtatatggacggactgacaatggcggagacaatcaggcagctgtatccgtctgttaaaattgtgattttttccgggtttgatgaatttgaatatgcaaaaaaagcaatcaagctgaatgtaattgagtatatcctgaagccggtgaatgtggaagaactgacggccatcctgaagaaaatcaagaaaaatctggatgaggagattgaacagaagcgtaatgtgaatctgctcagggagagttatatcaaaaatctgccgattatcagggagcatttcctgaatgacctgatccacggcggagtaccccgggatattatcccggagaaacttaaggagtatgatattgatatcgacaatgcccagaaatgggtaacggcagccgtccatctggaacccgatgaaaacgtggataaggcattgtcgcttcataaagagagggagctgattccgatttcggtcaggaatatgattgaagagaagctggatggacaattccgctttatcatgttccactcgtcctttgagagcgttctgatcgcggccatagatgaaaacaacactcagacggggctggtcgcgctcctgggcgatatctgcaaggagacgaagaaaatactggaggtttccgtcacaatcggagtcggggaagcatgtaattccctggccgacatagggggttccttccattccgccctgaatgcgcttggctaccgggccgtggccggttcaggcggcctgatttatatccgcgatgtggagccgttcaatcatggaaagctccagtttgacagccggatggagtcggaactgattgcagccgtaaaattcggaccggaagataaaatacgttccgttgtcggagacgtggtgggaaaaatggaggagacaaaggttcattaccgtcagtatcaggcatatatcctggctgttatcaacgccctgacccagctgtcacagcagtatgatctgagaattaatgatatgttcggtgtgcagaccgattattttgaaatccttacaaaggtggaaaagacggaaaatatcaggcagtatctcaccgaagtcgctttcaagatgaaccgggcaatggaggaagagcggagtaatacgacaaagaacgtaattcaggaggccaggcagtatattcaggagaatttccgggatcccgatttatcggtggaaaaaatctgccgtcatctccatatgagcccggcctacttttcaaccgtcttcaagaaggagacaggacaggcctacatcgcctatctgaccgacgtgcgcctgaaccgggcggtggagctgcttatgacgacggaggataaaacttatatcattgcagaaaaggttggatacccggagcagaattatttcagttatgtctttaaaaagaaattcggggtatctccgacaaaattcaggggagccagataaatggaaaaaaaggataataaccagaggcggccgttttttctgaataacagtatacgcaccacgatttttatttatttcacggtgacggcgctggcggccggcctgctgattacattttccctgtatcagagactttccgggcaggttacggctatggtacaggatgagaatcagaggctgatcggccaggtggcccgttcggtggaatcttatctgcgcacaattatgaagctttcggattccctttattacggagcggttaagaatgcggatctgtcgtcggagtcggtcggttctgagctgacgctgctctatgacaacaataaggataatgtggacaacatagccctgttttcggaggacggcatgctggtcgaggcggtgcctgccgccagactgaagccgaatctggatgtgacgggggagccgtggttcagggatgccctggaaaagacggaaaaccagcacttttcgcttccccatgtgcagtacatttttgacaataatgagaaccagtaccgctgggttatctcactgtcccgcgccgtggaactgacaagcggcacctccacggctcagggtatccttctggtggatatcagctactcaagcctggaacagctctttgacggcgtaacagccggaaagggcggctatgtctatctgatcagcagtgacggagagctgctgtaccatccgaagatgcagttgattgattcaggaagaatgcaggaaaacaatgtggcggcggcagcctataaagacggaaaccatatggaggaatttgacggaagcagccgttttgtgacaatcaaatccatcggttataccggatggaaagtggttggcgtgacgcctgagaatgtcgtcacactcaacacgatcaaaacccgtctttttattgtatttatcatagccctgattctttttatccttgcccttattaactcctacatctcttcaagaattaccaatccaatcaaggaactggaaaagtcggtgggaatcctggaggaaggcaatctggatgtgccggtctatgcgggcggctcctacgagatacagcatttgggtaaatccatcggggatatggcggcgcagatcaggctgctgatgaaggatatcgtcacggagcacgaggcaaaacgaaagcaggagtttgatacccttcagtcgcagatcaatccccatttcctctacaatacgctggatattatcgtatggatgattgaaaatgaacagaaggcggaggcagttaaagctgtaaccgcgcttgccaggttcttccgaatcagcttaagcaagggaaaaagcatcataacagtgcgggatgagctggagcatgtcagaaactacctgatgatccagcatatgaggtttaaaaataaattcacctatgaaattcaggcggaggacggcgtattggagcttgccagcctgaagctgatgctgcagccgcttgtggaaaatgcaatctatcacggcatggaattcatggacggagacggtgaaattcttttgaaggtatggaaagaggagggggatctctatttcagcgttatcgacaatggtcttggcatgacggaggaacaggtgggaaatctttttaccggagcctcccatgtagattcgaaacgcggttcgggcatcggagtcaagaatgtgaatgagaggatcaaactctattttggggagaaatacggcctgtccatcgaatcggaaccggatgagggcacaacggtaaaaatacatcttccggtcgtgacctacagtgaagccgtggagagggggatggtgtgatggcaaagcaggagaaaatcctgtgggggttttttgcgggaatacttgtctttttatatctcttatcctccactgatttgatcatcaaagagaagaagacggaaatttatcccgtttccattgtaatcggtgatacgacggatgactattatgtcaatttccgcaaaggtgttgaacaggcggccgatgattataatgttgacattagctttattactctttttgaaaaggaagatgccgacagccagatggagcttgtaaagcgcgagagcgaagacggagcgcttgcagttatcctggagccggtcgatccggtggaatgcatgagccatatggacacagcggctctcggaagtcctgtcattgtcgccggagaactgctcccggtggacagcgtaaaggcagcggtttccattgatcattatgaggccggtaaaaagatgggcgaggcaatcgctgcggaacatgaaccggaactgccggtttatatatttacggataaccagggacacagctacaacggggaggtatttgaggggcttaaatcggttttggaggagaatggctttgccatggcggtctatgagcggaaatcgcccgacacattccgtaaggtgattgaggagacggtgtatcccggaagcggtacggcagtcgtggcctgtctggatgcatccagcacaagtgaggcagccgatataattggcggaagcccggtctacgggcggtatattgccggcctgtatggtacggggacgacgccgtccctcctgggccagatggacaaaggggtaatccgcggaatgatagtctcaaatgagttcgatgagggttacctctgcgtggagaaagcagtggaagccatccggcgcggcagcgcaagggaacagattacgcttgaaacgtattatatagaaaaaacggatttaagggaaaacaaatttgaaaaaattctgtatccgatagactaggggggggatttctatgaagaagcgaacgcatatctggcttgcggcggccgccgcagtgattgccgtgctggccgggaccatgattatgaagaataacggcggggaaaagaaggaggacaaaaaatcaatccgcgtcggcgtggcgttgtaccgaggcgatgatccttttatcaacaacatccgttcaaagctggaggaaaaggctaaatcatatgaaaagggaaccggagttaaggtagtcatggatgtggccgatgctaagggaaatcagaatacgcagaacagccaggtggaccgttttctttccctgggctatgacgccatctgcgtaaatatggtggaccgttccgccgcctcctatgtcatcaacaaggcgatggatgcagatatacccgtgatcttctttaaccgcgaaccagtggaagaagatatgaaacgctgggagaagctctattatgtgggagaggatgccaaggagtctgcggtactgcagggaaatatactggtggatctctaccggagcaatcccgacggacttgatttggacggcaacggaaaggtgagctacgtgctgttagagggggagagcagccatcaggattcactgatccggacggagtggtcgatccagacattgaaggatggaggcgttcccctggaaaaactgacaggcggaattgccaattgggacagaagccaggcctcagctctgatggagcagtggatggaggaatttccgcgggaaattgagctggtgatttgtaataacgacgagatggctttgggcgccgctgatgccctggaacggggcggtgatacgaggccggtcaaaattgtcggaatagacggaacgccgcagggcctggaaggattaaagacgggcaagttgttcgggacggtccagtgtgacagcgaagaatatgcggacgtaatatttgagatagccgccgccgagtcactggggcagaatgtgcaggatcaggtggagctcaagcaggggaaatattatcagtgcagtcagatggcgctgacgtcggactcagtaagataagatttagttaagcagatgaggacgcagccgggacggccagcggacggggtagtggggtgtgtatatgagtctttcgtcccggtacaagattgttgtggtatggggctgcgggcgaagataaagtctgcggagcacgctcccgctctgtgaaatgcatcgcgctgctaggctcgaaaagacctcgccaatcagagatggatttcaacggcatccgcagactttatcttcccctccgccccaagggaaggttatcgcctggacgaaagactcaaggccaagggtatcgcccgtccgccggcctgcggccgctgatagtctcacgcgttaagtgcgggggcggaccttgtcgcggccactcagtgctaccatgtacgggaaatacgatatgccatcagggctttttaaaatattgcggaagattttgatatcggcctgccggaaacacgtagtggccgcgacaaggccctccccatttaaggttgaagacaatcagcggccggagcggaccatgtccggtgtgcgaaaaccttcgcctaagtcttccgtccctggcgaaaccctgaccgggggaaggaggttgaatcaattctgtaggggatatggaagcccatccgtgcttaatgaggtttctcacgaatttagcacggctatgcgcttcgaaaagtgcaaacggtccccgtaagaattcattccgaccggattcccctcacgacaaccttcaaccagggacggaagactcagccatccccctcaccacaccggacatggtccgctccggacgcgtcctccacacctcagttaaatctccattttgcttaactcccgtcggcccaatcaataaaaaattatcatgatctaaaaaaaattatataagtcccaaaaaaatcatatggaaatatgaccaaaagccatctataataagggtgtcgatgagttaaaataaccaatcgacaaaaaaatactatattaagggaggaactagtattatgagatcactcaaaaaattcatggcagcaggacttgcagcagcaatggtattttccatgacagcttgcagctccaaaccagcagagacagctgcaccggagacacaggcagagacaacagcagacaccactgccgaagctgtagaggaagcaaaaactgaagcagcagaagctgtcgagggaaaagatcctgcagaagtgaaggttggcatctccatttatcagttcgctgataacttcatgacagtatatcgtcaggaattagagagatacttaacagaagagttaggcgttaagaaagaaaacatctccatcatggacggaaagaacgaccagggtgagcagatgaaccagattagaaacttcatcacaacaggtgttgacgtaatgattatcaaccttgtacaggcttcttccgaaccaaccgtaacagaagagtgtgctaaagctggtatcccggtagtttacatcaaccgtgagccggaagctgagagagagcaggcttgggttgacgaaggaatcaaagctacttatgtaggcgcagacgcaagacagtccggtaccttccagggcgaagagattgctgagcttgagaacaaaggtgatgcagacggcgacggcgttgttcgttacatcatggttcagggtgacccggagaacgtagatgctcagtacagaacggaattctccattaaagctttaacagatgcaggcattgaggtagaagaactcgttaagatgcgtggtgactgggatcagacaaaaggccaggaaatcacagctaacgcacttgcacagcacggcgctaagatcgacgtagttttctgtaacaacgatgctatggcacttggtgcattacaggcaatcgaagcagccggcagaacagttaacaaagacatctacttagtaggcgttgacgctttagttgaggctgttgagaacgttatgaacgacaagatgacaggtaccgtatttaacgattaccttggccaggctcacacagcagctgacagagcaatggattttgtaaacggcaaagacgttaagaacgtatacatggtagactatgtaaaagttacaaaagacaatgcagcagagattcttgaattagttaaataatgtaacaaatcgttacagtaattctgctcggcagaaattatgagtaaatgcgtcgggtgtgtcatcttggcacacccgattttatgaaaggagagaatgggatggcagagtacagattggaaatgcgcggggtatcgaagagctttcctggcgttaaggctctggatcaggttaacctgaaggtccgtcctggtacggttcacgcgctgatgggagagaacggtgcaggaaaatccaccctgatgaaatgcctctttggtatttaccacatggatgaaggtgagatttatctggacggagagaaagtaagcatcgctaaccctgatgaggcgcttcagaaggggcttgcaatggttcatcaggagctgcagcccataccggagagaactgttgcggagaacatgtatacaggccggtatccgatgaaacggttcggcccgattaaggtgattgaccataagaagatgtttgaagagacggcaaagtggctggaagatgtgaagatgccctacaacccaaaggcaaagctgggaaccatgtctatcgcacagatgcagtcggtagagattgcgaaagcagtatccctgcaggcgagagtggtgattcttgacgagccgacctcctctctgacagacaatgaagtagatgcgctcttccgtatcatcagagacctcaggagcaggggggtatcccttatatatatttcccataaaatggcggaaattcgtgagatttgtgatgatattactatcatgcgtgacggtacgtatgtcggttcctggagcatgaatgatataacagatgatgagattgtaaaacagatggttggccgtgagctgacgaatatatatccgccgaagaatgacgccgaggttggcgaggttcttctcgatgtaaaaaattattccagtattcacgagcgttccttccagaactgttcgttccagcttcgaagaggcgagatcctgggcttcggcggcctggtgggcgcgcagaggacagagctgatggaagcgattttcggtatgcgccacatctcaacaggcgagctggaaatcaagggtaagaagacacatgttcagcgtcctcaggatgcaatccgggcaggtatcggtatgattaccgaggatcgccgtggtaccggtattctgggctgtctttccatcgcagacaacgtatccatatcctccatggatcagtacgtggaagcgggaataaagctgaataaaggaaagattgaacagcttgtcaaggataatgtggcgaagctcagcattaagactccgagcagcaagactttaatccagtcgttgtcgggaggcaaccagcagaaggttctgatttcacgctggctggcaaataatccggatatcctgataatggatgagccgacccgcggtattgacgtcggcgcgaaatacgagatttaccagattatgattgacctggcgaagcagggcaagggcattattatgatttcttctgaaatgccggaattaatcggtatgtccaaccggatccttgttatgtgtaacggacatattaccggagaagtgaaggacgaggaagcaacgcaggaacgcatcatgagctatgcgaccaagttctagtgataggaggaagagagaatggataagaaaaaagtcaatgtagcggacatactcataaataatggtattattatattaatttttctgatggttattttcgttggcgtaaccaaagaaaatttcttttccggcagtaacttcagcaacgtttccattaacgtagcctgccgtttcattatcgcagtcggcgtatccggctgtctgattacaaaaggtaccgacctttccgcaggacgtgtcgtaggtcttgcagcctgccttgcaggtacactgcttcagaaagcagattacagcggacgtttcgaacttaccaagaatttcccccagctcaatgtatgggtgattctcttaatctgtattgccatctgctgtatcttcggtcttatcaacggtattgttatatcatatttaagcgtaccggccttcatcggcactctgggtatgcagatgatcgtatacggaattaacctggtttatacaaaatccatcccgatcggcggataccgtacagactatacagccattgcaaacggtaaattattcggagtattcccgtatctgtttatcatcgcaatcgtaatcggcctgattatgtggtttgtttataactatacccgccatggcaaatatatgtatgcaatcggcggcaacgaggcagcggcagaggttgccggcgttaatgttaaaagaacgaaaattaaaatctatgtgacggcagctatactctatgcaatcgcaggcttcctgctgggcgcgaaatccggcggagcttctgttaacatgggtatgggctacgagctggaggccatcgcggcctgtacaatcggcggcgtatccgttaacggcggtatcggacgtgtatccggtgtcgtagtcggagttcttgtattcgagcttctgaagacatgtctccagttcctcggaattgacccgaactatcagtatatagcacagggtatcgttatcgtagttgctatagcacttgatatcagaaaatatattgccaagaagtaaaatggttttacatcgataacaagcacgcctcgcgagcctgttaccgccaattgataaaagaggagctgccggcgggactttcgtgttccgggtcgcggctcctcttttggaataatcaaaatactcagcaggcatacatgatgcatgaataagaaagttggtgtaaatttggaggaaaacagattagaacacagcgggagcgaggttctggaaggcgacggcgcgcaggaacggaaaacggcagagagcggcagggagctgaccggggaagagcagaacttaaaaagactggaggaagagaatgagaggctccgccaggagatagagcgcgtcagaaatcttcctttaaaagagagactctatgacaaagtgcatgtgtcggtgagaacactcgatattttcatagcagtgatgataatcctcggaattattgttattgttcttgggatgagataagtcctaaagggataaattgattaaagatattcgccccgggagtgggaacactccacggggctttttttgcaggcggtgacctgtatgcggagcatgcaggttatcgtctgctgcatcgaaaagggcgtcccctacgcttcatcaggaggacctgcaaaggcattctttgtaatatcaataaaattacgtgcggcagatgaaagatagctgtcttttctgtaagcaatgacaaaatcccagcttccgggggacggcagccggattagatggatgagagcctgctgttctggtattccccggaaaaggtgacgtctctggtaaaccaggaaggcgggacaaatgagtttgcatcctcctctgtctggaattctacctcagccagaacaagtccctcataatcgccgctgaaaatatcgagttcgattgtcagggaagtctccgggataggaatcagatagcgccgcttagacagaatttttccgtccgctttcttcagcagatgggcgtaggctttttcggtcagaggaaggttatattcttccctgaccatcttcccctttgatttataggtcagataaaacgtatcatcttcgcgtcggatacgtactacgggttcggtgcaaagataggcctgctcaatctgatgatacgggtattggcccggatcaaaggggagtgattctataaagtattttctttcaatttccatggatggttccttccttttctaaatgattatatttatcctcagacattgtggatacaatcagatattttccttctgtttcaggagattgtcgatgtttctgatatcgtgcctgtcaatctcacgcagttcatatcccgtatgaaatatcttttggcctattgccgagatacagggaactgttcttccttcgaattctgcgctgccgaaatattccggttcaaattcataccatccgccttctgggtcagcctgttttgccgtaccgttatcagaaagcagaaacgggtggatttttagttcattttaatatctgcccatataaatgtcaaacatcattctccttagtatccggattgtttaacggtgccgttaactatttcactccggatctcaaatcattatttaccaaaaacttgtatagctttctgaaaaaatatggtatactaaatttgtgttaaggttttcagccgtattatcaaggaggaaatgttatgtggtcaataggagatatgaagcgcaatggatgggcaaaggtaaagatatactactggtccgcttttgctgtaacactgatttgttcccttttgggcggcggagcaagccgcggcgggagtgtaaatacgtaccgcgaatacagggaggatatccatcacagcttcagcgggctaagtccggcggcactgcatatgattattaccacgttggttggcgtttttgccattgtgggaattgcggcactgctgtttaagatttttatcggtaatcctgttgtcgtaggaaagaaccgtttttttatggaaagcaggcagtcgcttcagtcagccggtatcggcaaggtgttctgggtcttcggatgcggaaactatatgaatgtggtaaagataatgtttctgagggatctttttaccgctctctggtcacttctgctggtaattccgggaatctacaaaggatatgaatatgcgatgattccctatatcctgtcggagaatccggaggcggacagccgcgatgtgtttgccgttacgaaggatatgatgaatggcaaccgttttcagctgtttctgctggaattatcgttcatcggctggtacctgctgggcgtgctattatgctgtgtgggcggtgttctagtggttccttaccaggaagcttccattgcggagctgtacagccatctgagaagctttatacatggtttcccgtttaacgggtacggtggagagcctgaagtgttttatgacaacggaaatcagggggacgacaggtatgataatcagaattacggcggtcacaatgaaaacaacggaaattattatgatgacaggtattaaacgctcctgacaaataaaccggtttcggttataaaatttatagaagaggtgacaacatggcagaggtatatgcatttttggcagatggatcggaagaagtggagtgtctggctgtagcggacatcctggtacgtgccggaataaaggtgacgctggtatccatcagtaataacaaagaagttacaggttcccacggatttacaattgtggccgataccacgattggagagattgattttgaacaggcggatttgctgttcctgcctggcggcatgcctggtacaaagcgcctttccgagtgcaggccgctttgtgatgcgcttgtaaaggcgaatgaagagggccgccgtctggccgccatctgcgcggcgccaagtgtcctgggcgggttaggcattctcaaaggaaagacggcaacctgctatcccggttttgaaggggcattagcaggggcaaatgtgacaggcgatggcgtagtgaccgacgggaatgtgacaacggcaagagggctgggatatgcgctggatttggggctggagcttacaagactgctgctcggcgaaaaaacagcatcccatatcaagacggcaattcagtatgatcagatataaaggaaaataaacaattagagaacgggaaaagcaggggaaaaaccataaaaacccttgtattttcccgtattttctttggttttttctgaatttgtgctggtatttacagatggtatatgatataatgctatcttgaagtgtaacgcctaacgggtacggctgttcacatatataagcaaggaggaacccttaaaatgagtttacaggtagaaaaattagaaaacaacatggcgaagcttacgatcgaagttccggctgaggaattcgacgctgcaatcaagactgcttacaatcacaataaaggaaaattcaacattcctggtttcagaaaaggtaaagcaccgcaggccatgatcgaaaagatgtacggagcaggcattttttatgaagaggctgctaatgcagtaatcgacgcatcttatccaaaagcagcagaagagtgcgagaacgaaatcgtatcctctccggagatcgatgtaacacagattgaaaaaggaaaagcatttatttatacagcaaccgtagctatcaaaccggaagttacattgggtgagtataaaggagttgaagtagagaaggtaagtgcagaagtagcagacagcgatgttgatgcggagctggaggctgcccgtcacaagaacggaagactgatcacggttgaagacagaccggttgccgacggcgacaacacggtaatcgactttaagggcttcatcgacggaaaggcatttgacggaggcgaaggcattgattatcctctgacaatcggctctcattcctttatcgatacatttgaggagcagttaatcggtaagaaccttggcgataaatgtgagattgaggttacgttcccggaggagtaccacgctcctgaattagccggaaagcctgcaaaattcgaagtgacaattaaagagatcaagatgacggagcttcctgaattaaatgacgagttcgcaagtgaagtttctgattttgagactcttgctgaatataaagacgatatcagggcaaaactccaggataagaagaacagagaagcagctacagagaacgagaaccgtgttattgataaagtagttgagaatgcccagatggacatccctcaggctatgattgatacacaggcacgcggcatggtggaagattatgctcgcagactgcagagccagggcctgaacatcaacgattacatgaaatataccggaatgacagcagacaagctgatggagcagatggctccgcaggcacttaagagaatcaagacaagactcgttcttgaaaagattgtagagcttgagaacatccaggttaccgacgaagccgtttaccagcagattggcaagatggcaacatcctatcagatggaagccgagaagttaaacgaacttttaggtgagaaagaaaaagagcagattaaagaagatttaaaggttcaggaagcagtagatttactggtttcagaagcaaaactggtttaatcgccgtataatgaataagaaatgaaatttggtacagaattctatgggactggtagcctgtggggttctgtaccattgatatcggtgaaaagctcattacctggacttttcatcgttgattgtcggtgaaaggtccgcagagcgtacttttcatcgtttccattttgcagaacaggaggcattctatgagcttagtaccctatgtcattgaatccaccagccgcggagaacgttcctacgacattttttccaggctgttaaaagagagaattattttcctcggagaagaggtaaccgatacgtcagcagggcttattgtgtcacagcttctgttcctggagtctgaagatccgaataaggatattcacctctatatcaacagcccgggaggttccgtttcggcaggtctggcaatctatgatacgatgaattacatcaagtgtgatgtttccaccatctgtttcggcatggcggccagcatgggagcgtttctcttagcaggcggggccaaaggtaaacgattcgcccttccgaatgccgaggtcatgatccatcagccgtccggcggagcgcaggggcaggctacggagattcagattgtagctgaaaagattttacagacaaagaagaaattaaatgaaatcctggcagcaaatacaggccagccatatgaagtcattgagagagataccgacagagacaattatatgacagcacaggaagcaatggaatatggcttgattgaccgtgtcattgcaagccactaatacaaggaattgaggtgggcatatgccaggcagatctgatgataagattcgctgctctttttgcggcaaaacgcaggaccaggtcagaaaactgattgcaggttctaacgatgtttatatatgtgacgactgcatcgaactttgtgcagaaattctggaagaggaatttgcggatcagaatgacaagggtccggacttcagtgggattaacctgttaaagccgaaagagatcaaggaatttctggatgagtatgttgtgggccaggatgaggccaaaaaggtgctgtccgtagcagtctacaaccattacaaaagaatcacatccaagggaacacaggaggtggagcttcagaagagtaatatcctgatgctgggaccgaccggctcaggaaagacttatctggcgcagacgcttgccaagatcctgaatgtgccttttgccatcgcagatgccacaacactgacagaggccggctatgtcggcgaggatgtagagaatattctgctgaagattattcagtcagccgactatgatatcagcaaagccgaatatggtattgtctatatagacgagattgataagattaccaaaaaatcagaaaatgtttcgataacccgggatgtttccggcgaaggagtgcagcaggcgcttctgaagatactggagggtactgttgcgagtgttccgccgcagggcggaagaaagcatcctcagcaggagctgcttcagattgatacgacgaatattctctttatctgtggcggagcctttgacggactggaaaaaatcattgagaaccgtctgggagccggctctatcggctttaacgcagagattgtggataaacagaaccaggatatagatgaattattaaagcaggttatgcctcaggatttgactaaatttggtctgattccggagtttataggccgtgttccggttacggtggcactgcgttccctgtcggaagacgcgcttgttaagattctttccgagccgaagaatgcgattatcaagcagtatcaggcattctttgatttggacggcgtaaagcttgaatttaccgaggaagcgctgaccgcgatcgcccatctggcagtggagagaaagacaggagccagaggactgcgttccatcatggaatcgattatgatggatatcatgtatgagattccttcagattccagcattgggatctgcacagtcacgaaagaggcagtggagggaaaaagcgaaccggaactcgtatatcgtgaaaatacagtaccccgtaaatcatttacagggcgtttaaaaaaggataagacaggcgaaatagcctgatagggcctgtcatagccttaggcggaaggggtttgtaagatgaagcattgtcattttacagatccctttatcgttgaaggcggtaataagcctgcaaagcatgtttgttgccgtatatacagaacaggagacagaggatggaagataagaagatgatacttcctgcgatagcgctgagaggactcacagtgcttccgcagatgacaataaattttgatattatcaggggaaaatctatttccgctgttgagaaggctatggtaggcgatcagaaagttcttctcgtgacacagatgaagacggaggagatgaatcccgatatagaggaccttttccatgttggaaccatcggctttgtaaagcagcttgtaaagatgcctggcggaatggtgcgggttacggtagaaggacttgagaaagcggagcttctggaactggactgcggcggttcctccctgactgcaacagtggagccgcttggcgccatagaggatgacttaaacgtaatggagaaagaagccatgctgcgcatcgtgagggagaagctggaagaatacggaaagctcaatcagacagccgggaaagatttcctgctgactctgacctctattgcgggcctggaagaacttctgcatcagattgcggtacagtttccctgggattacgaggcaaggcagaaaattctggaatgtacctttttaagcgcaatgtatgagacggtactccagcttctgttgacggaaacagaggtttaccgcatcaagaaagacttccagacaaaagtaaaggcggcaatcgataaaaaccagaaggattatatactgcgcgaacagatgcgggtaatccgggaagagcttggtgaggacagccccatatccgatgcggacgagctgaagaaacaattaaagggcattaaggctgataaagaaatcaaagaccgtatactaaaggaaatcaaccggttcaagggaatgccgtcgggaagccaggacgccaatgtactgagaacgtatcttgagacggtattagagctgccctggaacaaaatgacgaaggacaatacggatttaaaatatgcggagaaggtgctggaggaggatcattacggacttgaacaggtcaaagagagggtgcttgaatacctggcagtccgaatcctcacaaagaaaggttccagtccgattctctgtctggtcgggcctcccggaacaggaaagacatccattgcccgctccgttgccagagcgctgggaaagaagtatgtccggattagtctgggcggagttcacgacgaggctgaaatcaggggacacagaaaaacgtatgtcggagccatgcctggccggattgtggaggggattaagcacgcaggcgtgagtaatccgctgatgctcctggatgagattgacaaggtgagccgtgattataaaggggatacatcgtccgcgcttctcgaggttctggacagtgagcagaatatccatttccgcgatcattatgttgaacttccaatcaacctctccgaggtattgtttatcgctacagccaataccacacagacgattcccggaccgcttttagacaggatggaagtgatagaggtcaacagctatacggagaatgaaaaattccatatcggaaagaactacctgatccgaaaacagatggaaaagaacgggctgacgaaatcacagctgaccatcacgaatcccgcgctggagaagatcattcataactataccagggaagcgggtgtgagaaatctggagagaaggataggggacatttgccgcaaagcggcaagagagcttcttgagatggaaaagaagtcaatccgcataaccgataaaaacctggaaaaatatcttggccgcgagaaggttctgtttgatgatgccaatgaggaggatcagataggaatcgtaagaggccttgcatggaccagcgtcggcggcgatacgctgcagattgaggtcaatgtaatgcccggcaaggggaaccttcagatgaccggccagctcggcgatgtgatgaaggaatcagctcagacggccctgacctgggtgcgttccgtggcgtttgtgaaatatgcagttccggaagattattttgagacgcatgatatacatatccatattcccgagggagccgtgccgaaggatggtccgtctgcaggcattacgatggcggctgccatgctttctgccgtaacggagcgtctcgtatcggcaaagactgccatgaccggcgagattacattaaggggtcatgtgctgatgattggcgggctgaaggaaaagcttctggcagcaagaatggctcatattgaaaaggttcttgttccggagaggaacaggcctgatgtagaggagctgtcaaaagagatcactaagggtatggagattgtctatgtaaaagagatggaagaggtgatccgcgaggcatttgtaccggtgagcggactgaacgctccggaaacagctttggaggatatccaggcagaaacagcggacgaacctgctgccagagcggctgcagaagcggctgccgccgtatccgtgcacccaaaaagaaagggaaagtcatgataataaaagatgtaaacctggaaaccgtttgcggtatcaccagtaaaatgccggaaaacacacagccggaatttgcttttgcaggcaaatcaaatgtagggaaatcttctctgatcaattcgctgatgaaccgtaagtcctatgcacgtatctctgcacagccgggtaaaacacagacgattaatttctaccgtatcaatgatgcgctctattatgtagatttgccgggctatggttatgcaagggccaatgtggaggtgaaggccaaatggggaaagatgatcgaggattatctgcaccagtccaagatgctccgatgtgttttccttctgattgatatccgccatgaaccatcctccaacgataagctgatgtatgactggattgtctcgcaggggtatcagccggtcattattgccacaaaggccgacaagattaagaggagccagctccaaaagcagatgaaaatactgaggaccggcctggagatcggaacagacgtactgatgattccgttttccgcagaaacaaagcagggacgggaagaaatctgggactatatagaaaaactggcggaggaataaaaaagtcatctgtcacagcactgagctccggctgtctaatcttatataaagaataagacagagaaggagaatcatatgaaaagtacagataacgacaggaaacggcagaagctggaagctctggcagaacaggcgaaagccggcagtaaggaagcggtggaagagattctcatagaaattcaggacatggtgtttaatctctccctgcgaatgctgggaaccattcatgatgcggaggtgcatcccaggagattttgattaaggtaatgacacatctgtccggtttcaggggagagagcgctttcacgacgtgggttttttccattgccacgaatcatctgctgaattataagaagcatctgtttgccaatgcgcctctcagctttgaattttacggggaagatattgtcaatgggaagacggaggatatccctgatatgagcgggggagtcgataaaaatcttctggaagaggaactgaaaatgtcatgcaccaatgttatgctgcaatgtcttgacggggagagccgctgtatttacatactgggaaccatgttcaaagcagacagcagaattgcaggagaaatactgggaatgacgccggaagcgtacagacagaagctgtcacgcatcagaaggaaggtggcggagttcctaaaagaatactgcggtttggccggaggacggtgttcctgtaaaaagagggtcaattatgcaatcgcaacacaccgcattaatccgcagcggctggagtatcaggctttgtcaacggacggcatgcaggccagggattacatgcaggcaatggagcaggtagatgactgttcggttgtattttcggagctgccgatgtacggggtaacccaaacaacaaaagagatgctgagtggatttcttaattcagaactctgtatgtatattaaaaatgcataaataaaaacatatacaaaacccggtcaaaaggagcagatcacaccatgtcctttgaccgggtataaaatttcttaatcctgccggaacagtatcttacaaatcccatccatcacaaaatcatataattttcggatccattccatcgagcagaataataccagcactgctgcaaagaccgacataccggccaggtttccccagacactgccggcaagcggcaaaaatttcgctatcagcagatagagggccggggcggcgaaggaggagcctgcatagacaagaattgcattggtacctacttgggagaatatatttttcctgtccgggaaaagattgattaaagctcctatcatcagaatggcgatgagatagaagagggcgcggtaacctatcccctgggcgggggacagccccaccgattcataagtaaaacggacattccgaaagctgtagggcagcaggacggatggtataaccgcggcggccaggatggcggcggcaattgcatgcggaatattcctgattttctctacgtgttctttcgtacataaaagacccagcacgaagaaaatcatcagggaaaagcaagctccccagccgatatggaacgcttcgtcgaagacaacgcttatgaacaaccctgcggcaaaggaaaagagtacgggaaatcggagctttttaagatccgctgcaaaaactttccatacaaaaacgcagaggagataataaagaggactgctgggaagcagtagcgacggcttaaacacatcggtattatagcttgccagtcccagcctgatgaagagcagggccgttataatatagagaagctgccagaaaatgtaaggaaccagtacatttctaaccgcgctgtttctggctttctccgtgtttttggtgaagtatccggtaataaaagcaaacatgggcatatgaaacagataaatatactgcatgagataccggtaaaggctgtcctggcgctcgatgtagggatctaaaatatgtccgatcactacaagaaagagcatcagggcttttaagttgtcaaacagatagtcgcgtttttccgtaagttttgaattcataatattaatcccgttgtttttcctgttctgtgatttttgattgtccctccagtaagacggtattatccgccttttgtccgatagcgcgtattttaagcttcaggtactgttttgccgtctggtaggccacgacaatcaggagtatgggcaggacaaagaggagaaaccatttgatttttaagataacgtattttctttttatccgtttaatatctttgtttatagttagtttcaatgtctcaattgcactgggcggtgcggccggttttccaatcataacgcctcctgtaaaatatccggtaagtctgcgtgaagccggaatcatgatattccggccccacgaatgttttcttattttattatttccctttccccggtgatttatcgctcatcagggatttcataatatatgcatagatttcctggcttctgtctctccagtggctgcacatcagttcagcctgttctttgtccggcacggagacgtcaatgccaaccaggacattctttccttctctgacctcacaatgaacgatataatcctgattagtggatttgtaaaaatcagaaacaagacccacttcatttcgcatgcggaagcggttttcctttaaatattcatccatatcctcaacgatggcgggagaaatcttcttgccgaagaattcgagcgtctcttcgccttccctggtaatctcgtatcgggtgctgttgtgcagcgtctgcatcttgatcaggcccgcttccagaagttcattgagggcctgctggagcgtgaagtaggtggtgtactcacgatccagaaagaagcctgacagctgtgcatttgtcagcgggaaattcacctgtttcagcatgtacaggttcatcagtttgtataaggtcataggttcggacagcatggaaatactcctttattctaaatggttaacgaagacaccttgcggaatactgcctgcagcagctaatatggtaacagttcatactgtctgaaatgttactgaatatgctctttaacagctctgcttaccacatcggccactctcggatcgaatgcggcaggaagaatattttcgtcgtttaagtcactgtcgtctacaagccctgcaattgcggctgccgcggccagtttcatctcctcggtgatggctgtggcacggccttccagggcgcctttaaaaataccggggaatatcaggacattgttgacctggttcgggaaatcagagcggcctgtgccgactaccctggcgcctgctgcctttgcaatatccggcataatctcgggcaccgggtttgccattgcaaaaagaattgcgtccctgttcatggaagaaaccatctcggcgctgacgataccgggggcggaaactccgacaaagatatcggcgcccttgagcgcgtcggccagcgttcctctctttccttccaggttggttacttccatcatcttttcctgcatccagttcaggccgtccatacccctggccagaatcccggctttgtcacagagcatgacattcctgaaaccataggtaagaagaagtttgctgatggcaattccggcgctgcctgcgccgtttacaaccacgcggcagtcctccctggttttgcccgtcaccttcagggcattgataataccagcgagaacgacgattgcagttccatgctggtcatcatgaaatacggggatgtccaggagttccttcaggcgttcctcaatttcaaaacagcgcggggcggaaatgtcttccaggttaatccctccgaaagcaggagcgatacgcacaaccgtctcaatgatctcgtccgtatcctgtgtgtccaggcagataggaaaggcgttgacgccgccgaattctttgaagaggacagcttttccctccatgaccggcatggcagccagagggccgatattgccaagtccaaggactgcgctgccatcggaaacaacggcaacggtattcgccttgattgtgtatttataagcagcatcaggattctcggcaatcaccttacatggctcagccacgccaggtgtgtatgcgagagccagatcctctcttgagtttacttctgctttggatacagtatcaattttaccgttccatttttcgtgcagcattagtgctttttcactgtttgtcattgtgatttcctcctgaacaaattctcttgtttctataatagcaattttacattcttaaatcaagaagataaatggatatttaactgaggttgggaggacgcgtccggaacggaccatgtccggtgtggtgagggggctctctgagtcttccgtccccgtgggaggttggtcgtggagggggaatccggccggaatgaattgctgcggggaccgtttgcactctttggagtgcgcatcggagtgctaagctcgtgaggaacctcgctaagcaccggcggactcccatgtcccctccgcaattgattccgcctacttcccccggcagggtttcgccggggacggaagactcaggtaaaggttttcgcggcaccggacatggtccgttccgggcgctgattgtctccagcctcaggggggacgggaaccttgtcgctgccactacatatttccgatagataatagtctgtgcagtacggttattcctcgattctaaatggagatttaactgaggttggaggacgcgtccggaacggaccatgtccggtgtggtgagggagatgactgagtcttccatccccgtgggaagttggttgtggagggggaatccggccggaatgaattgctgcggggaccgtttgcactctttggagtgcgcaacagtgctaagctcgtgagggacctcgccaagcaccggcggactcccatgtcccctccgcaattgattccgcctacttccccggggcagatttttgccagggacggaagactcaggcggaggttttcgcggcaccggacatggtccgttccggacgctgattgtctctaaccttaaatggggaggaccctgtcgcgaccactacgtgtttccggcaggttgatatcaaaccttccgcaattctttcataaaggcgtattgtaggcatatcgtatgtttcgtacatggtagcactgagcggtaacgacaaggtcagccccccgcacttaacgcgtgagacattcagcgcccgcagtcccaactcacaacaatcttcccccgggacgaaagactcataaaacaatcccaccaccccgtccgctggccgttccggcggcgtcctcacctgcttaactaaatctccattaccgaattaagttgtaaaaagtcgatttatgtagtgtaattgcggacaaagtatgatagaataattaacaatgagagcgacagcaggtggtaagtatgaaagaaaggattaaccgtctggcgaagggaatcatcgattcggatcttccgaagatgatttggacgccggatgtgattgaggatacggtacgggttggcacgactgtgaagagggagatttttatcggcagtgagaacggcctgaatgtaaaagggttcgtctattcttccaatatccgcgtgcgcattccaaatgacaataatacgtttggaggactccggaatcatatagtttacgaagtggatacttcttttttatcggcaggagatgagatagaaggctctttttatcttgtgacaaactgcggggaaaaggagattccctatctgttccatgtagatctcgccacatcgggcagaatactcgggaacctgaatacggcaaaagactttttagaagtcgcggagcatgatatggacacggctctgcgccttttagagtaccaggattttacagaagcgccttttatgcaggacatgcatacgagggctctttacgacagccttaaaggccatgggagcaggcagaactttatggaagaattcctggtggcgctgggagttaagaaaccaatccgcctgatggttgaggaagataaaaaagtttatgacaatccgggcagacgtctggaggattttattgtaataagaagcgacacctggggatacatttatctggaagcttctgcggacggtgactttattcatctcccgaagaagagcgcgacccaggctgatttccaggatggaaccctgcggcttccttttaatattctgtcggaacgcctccatgtggggaaaaattacggagcgattctgattaagacggcgaggggaatcacgaaaattccggtggaagccacggttaacagctcccgcgatgcggaacgcgccgttttccgggaggagatgagggaatacctggaactgcgcctggagtatgagagcggaatgtatgaggacgctctgattctgaatcagatgcagaaggagctggatctgatgaagatgaccagtgagcagctgctcctgtctttgctgcaggcagagatctatgttctgacgggccgtcaggacaaggcctgcctgattctcgacgaagtaagggacagcgtcctgacaaaacggctggagcagaaggagctgtactgcttctatcaatatctgcaggtgaagatctggaatgacaaggagcagaaggactctctgatccgtctgcttcaaaagtactgttccgaggaggacagatacagaaatgattttatactctatctgatgctgctgaaagtgaatgaggaattatttgagaatccggttacggttctcatcagcatggagcaggagtttaaggacggctgtcacagcccgtttttatatgtggaatgcctgaagctgcttgaaaaggaaccgggatttttgaagaatatggccaggtttgaattatacgcactctatttcggcgctaaacgtggaatggtaagccgtgacctggctctggcggcggccaaagctttaaatggggcgaagggctttaaggaaatttatctgaagcttctttgccggctgtatgaaatgtatccggagcaggagattctttcctccgtctgctccatgatgataaaaggcaactgccggggaagccgctgctttgagtggtatgacaaagcgattaaagcatccgtcagcctgacccggctgtatgaatattttctgtattccctgccggaagattatgggaagctcctgccgcgggaagtacttttgtatttttcttattcgacggaactggacgcgcacagccgctgtgtgctttacagcaatatactggcctatacacagagggattccgatatttaccggctttatgaacgggcaatcgaacagtttgcgctggaacagctctttgccgggagaatcaacagccgtctggcagttatctacaaacacatgatctataaggaactgattgacccacagcttgccagggctctgcctgcggttcttaagtctaaccggattacctgccgtgacgccgcgatgcggtatgttgtggtgcgccatggcgaactgatgacagaggatgcttatccgctccaggatggaactgcatatgtaccactgttttcggagcgggatattattctgttccaggactccttcggcaaccggtacctgaatatacggtatgaaaaggtatcagccatggaggcggtggatgagctgctggaatgctgttttgaagtttatccggatcatcccgtactgtttgtaaacgcctgctatgaagcgatggagaaggaggaactgaacggggacaatgcagcccttctggaactggcagatcagaagatgaagctgcatccgctgttccgttcacggctcatgtccgcgattgtcaggtattataaaaagctggcggatgagagcggggatgggaacagaaacagcagcgtttcctatcttctctgccttgacaaggatgcactgaccagggacgagcggagcggtgtctgcgagacgctgatccggcagaactattatacggaagcttatgagatgatctgccgctatggaattgaaggcatccagataaaacggcttttgaagctgtgtacgaagatggtactccagaacctgtttgacgaagacgaccgtcttcttcatctggcatatgtggtttttctggaagaaaaaagtgacagtgtgattctggactatctctgtgagcatttcaacggaaccgttgatcagatgtaccgcgtgctgatgcaggggattaaggagcacgtggagacgtatgacctggaagaacgcctggtagcgcagatgctctttaccggctgtacggaaaagatggatcgcgttttcgaactgtatgcgtccagaaagaagacgagtgaaaatgtggtgaaggcatacttcacggtgaaaagcatagaatatttcctttacaacaaaacgacggaggataaggtctttgcctatctggaggcagccgtcaataacagcgtggagaaggacaaggtgccggatatttacctgctggccctgaccagatattactccacacttccggcgcttcaggatgatcagctaaagctctgtcaggcggtaatcgacgttttaatcgaggccggcatgatatttgcctattttaaagatctggcaaaattcattgtcattcccggtaatattctggataaggaaattatagaatatcatggcaataaggagatcaggccatatctgcgccttcggattcttccggaagaggaggagtaccactacgaggatatgcgccctgtatacaaaggcatctatattcgtgagaaagttctgtttgagggggagatcatggaatatcagattcttgaggatgaaaatggggagaggaagacggtggaggaaggaagtatttcctgcaaggaagtaacgacgagaactttggggaaccgttttgcctgcctcaatgagatgagtctctctctggagcttaagaatgaggcggcgctcagggagcagatggaggaatacttgaaaaaggatgcggccgtttcagagctgtttacgttacagtaaggccggtgcaccggcaggtgaacggtatcttataatgtgcggccgtgttttgaaaggacttttagaaaatggacggacttgtaataggaatggatttgtgtgatacctacactcatatttcgtgtatggaaccggagcagacctgggtaatccctactgttgtctgcaagaataagaatgcagatgaatggtatgtggaggaggaagcttacgcccataccctggtcggtgacgggattatggaggataagctcctaacacaggttatgaaggacggtacggctacaatcggcggaatcaaatatgaggggatatatcttctgaaaatgttccttgagaaagccctggagctgccgaaaaaggcggccggcagccgggagatagccagtatagtgattgctgtaagctgcctggatgttaagctgatggacagtcttctttactgtgccgattatctgaagatcccgcgcgacagggtacatctgatcagccatacggaaagctttgtctactatgtgatgagccagaagcgggaggtctggagcaatcaggtgggaatgtttgacctgacgaaccagagcctgcgctattatgagctgaaggtccagagaggacttcgccagatgcaggtggtagccgattgtgagaacctggaggagggcttccatctcgatgtgctggataacacggcaggcgccaggctggcggatcggattctctgttcctgtgcggaccgtattcttcaaaagcgccttttttctgccattgtactgaccggaaagggttttgagaatacggaatgggcgccggagtttatgaagcaggtgtgcagccgccggaggcttttcgtggagaacagccttttttccaaaggcgcgctcatgaaagctgccgattacctccaggaaaaatcatcgtatccatttatctgtatctgtgaaggcaggcttaagacaacggtttccgtcaaggtgctgaatcacgataaagaaggacagctcgttttggcggcggccggagataactggtatgaggcgaagagtacggtggattttattgtcaccggtaatcctgaggtggaatttaccatttcgcccctcgatcccaagaagaaaaaactggtaaagattggcctggaggactttccgaagcggcccgacagaacgacaaagatagagctttcactgggcttttccgatgaccgcaccatggtagccgtgataaaagataaagggtttggtgaaatttttcccgctgaggatgttatgataaaacaagaggttggattatgagtttgatactttgcagacatgagccggttagacatccatattatatagaacgcctgggaatccatattgcttcttcccaggagctttgctatgtgatttataataatcccctgctcgccatggaagggctgattaatgataatctgatcacatttatacggacggaattggatatggcattcctggcagggaagctggatgtctgcaagaagagcggggaagacccggatgaaatgatttttatcattcttcaggagtgctattattatacggccagggagataggcaagttccggcagaaaatagcgtcctacaagaagatgagcgctgccgaacttacaaaggagacggcagacttttatttcaggctgaaacagtacggcacggccgtgatttattacgaaaagattctggatgactggcggattaaatctctcagcgatgaatttaccgcaaaaatatggaataatataggagcctcctacgccggaatattctggtttgaaaaggcgatgtcggcatttgatatgtcatataattttcaaaaaaacagggagacgcttaagaaaatataccagctgaccctcctgaatccggagcttacactgaaggagcgctatgaatctctgataacccgccagcagaaggacgagtggaaagaagaattcgataagctgacgcaggcggcatcggaggaccgaaagatcagggaggtggaggaattgtttgacaaggatcctatcaaacggatttcaggcgccgggaagctgcttgcgaaatggaagcaggattacagaaaaatgatctagaaaagtaacaggaatggggagaagttattcgatgaaagaactgaaaggatctgtatatgccgtcatttcagctataatatttggctgcatgccgattgtggcaaagtatctttacgcggagggctgtaatcctgtcagccttgtagtataccgttacagccttgcgctgccggttctgctgatactggcattgagggaacaggggaaagatgaacgcgaaagaaaagcagcaggagagccgtccaagcgtgattcaggaatgaggattacgatgtcccagctctgccagtttattatactgagcacaggattttcactgaccccgatcctgctgttttcctcttataattacatatcgagcggaagtgctacgacgattcatttcagttatccggtgcttgtaattctggcctctgtctttatctttaaggagaaggccacctggacgaagattgcttcggtggtattctgcgtcatcggcctggttcttttttatgaaccggggcaggcgaacggagcggccggaattcttctggcgctggcgtccggtgtcacttatacattttatatgatgtattttgaacgcagcacgctgaaattcatgaaaccattcaagacgaatttctacatgtcgctcgtatcggcagtgatggtatttgtcctttctctggcgaccggaacttttgtgctgtttcattccatacgggggtgggcggcagctttcggtttctctttcatgctgattgttgtagcctgcgttctcttccagcttggcattgccatgacaggcgcacagaaaacggcaatactaagcacctttgagccgcttaccagtatagtgctgggagtagtctgctttggtgaagcagtggggattaagacagggattggcgtggcatttattttggcatcggttatctcgatcaccctgtttggacggaaaaacgcctgaggctggcctgaaccgcatgctctgcgtttatactcctgcttttggccggttattttctctcaccctggcattcagttgtctgattcgtctctttgttaccgaatacagcgaaaaccatatcacaaaatatatggcaaaaaagagcgcgaagtagagagatatccccaataaactatgctccatccatcgaaggaggtatgcgatggggaaggttgcggtggagccaatgattaggtgggttattgtctgacgcagcagactccagttttctttttcccaaaccacggaggagcctgcccatatggcgccatagataagtgagcatactgactgaagcaggacggcattaatttccgaaccgcaaagggcggtaagctccggcacgacggcgtgaaagcggccgtcgccgataaacagggaaataataatcgtgatggcataactgatggcaagacctgtcggagcgccaaacagacagcggtaaaacaaattttttttcatattgaccacctcataatcctaataattgtttgattttggcgatgtagcgccgtgaaacataagtaaccgcgccatttgacagggatacgcaaatcgtaccggtgaagctcatatcgaactcctctatttttctcagattaatgatttccgaatttgaaatacgaacaaagaactttctgtctaacctgtcttcaagctcatacaggcgcagccggacctggtattcatcgtcttctgtcacggcgaaaaccttgctgtttgccgcataaatgcggattattttttcttgctccagcagagagactgtctcctttttgaagccggcaaggagacggggcttttcttctgccagacgctgcatcaattctgatatttcatctgtgattttatttgtcatgatgattattcttggctcggacagagtttcatcaattttgatctcaatctgcattcccttcacccccttttcaatacagttatagtatagcgaacttacaaatcagaagccactgttttgcgatagatggttgttttagacgcataagcggtaattgtctccgcacttttttaccggcttataagctgtccgatattcttaataagaacggagatcgtcccgtcttcattggtaatgaattccacgtggtccggattccggtattcttccattggaatggagatttcaatacccgtatctgtggtgagatgctgtttctggaatttcttgattgtctgctcgctctttggctgaactgtctcgtaggacatattgtacttgtccagcttttcgtcaagctctacctgcatctcaggactgtccggaaaaatcttctcttttattgtggcgacttttatctcgcctgcctcttcaagctccgtacaaagaacattctttatttccattctgcgttccggcgcttcgtcgccgtaatactttttattgacctgttccacggccctcgttacaatatccagcttcgatttttgtgacagcggtgcgtggcattccaggaacagctccgaaaaataaaagcgcttttcgccgttaacctcatattttttctcggtcaggagaatgcttccgtcggagaggttcacaatgaaggcctcggacagcttctgtccctgagccggcagcagagcgcgctgaagaataatatcattgcggttacctccttccgcttcgcgggtggcatgggtatatgaggtcttgtaattcatcttaagaaagccaagataatcgcagccttcgcagctgaagacgagaatggcaatgtcggctgccggaatatcgatgttggaattcatgatatcatagagattctctgcaagctgcttgctggtttctacgaaattatcgggcgtacagttttcaatcagctctttcagcggggagctgtcggagaagctgcactgtttgatatcatcgctctcggtgattttttcaatatgcgcctttaagaaatctgaaaaatcagggccgatttccatcgcctggtcggaaagcaccggtatccctaccgaagaatccaggatatggatgatggctgctttcatgattatatcgtcacttttcatatgtagttatcctccttttcaaacatgctctagtattatagcggaagggaaaggaaaattcaataaaaggatgagaatggagaaccagggttactgttcacacggttgttttccgcgtggtattattgttcgcaccgcgccgcttttgggcggggtgtgaactgtaacggacccggtccgttctcctgacattgattgtcttaaaccccagctcacagcgctcctccctggctgatacaggataaggccctccatgacaaaatacggatcatggaaggccttataaaacgttacgctatatttatgaatcaagtcactaatctaaaaattctatcacatccctgacattcccgtcatccgtataggtaaacttcaccttttcatctgctttcaggaacgggagcagctccgatacggatatctctgccgtgtaaacctggcggcttcccttcagcgtgaagtagtagcaggtatttcctccaactacggcgctttcaatcgcgtcaacggtgccggagatttcagtgccttccctgatttcaggaattgccacatcttccaggtttaaggcggtgcgataattgcgcttagcctcgtcaatcgtctgcccggtaccgacaatctggtactgttccacatcgacaaacgcatacatcttcacgagtccggccgcatccttcagcgaaatgaaataggtcggcctgtcggatatattcaaaagaagcgggaaggtagctttatagttcagatgctgtacctgtccctgggccgattccatcgcggagagttcggtggctccgggaacggcataaaatttagtatccttcgtccttaagttaaccagaacaaatccgatattggattcatccgatgtaacggagctcatacccgtatacagataaacgtcatcgtcaatcgccaggtaattatatccgtaggtggtacggcgcacattcctctgtccgaaaatggagttaatgtaaccgttctggaaccgcccgttatcatcgagctgttcgataatcagattggaatcatagagctggtcaatccactggggaacatcagccttatcgtagtaagcggattcaccggttacggcattgacgagtaccgcgccgtcaatatcttttccattccaccagccgatccggtatgcgatggttggagccacccagtagggcgtgccttcatcatcgatttcaaaagagacggtctcaaacatcttagtcggatatttaaaacggatatagcggtaaatattgcggaagaaatactcggtcgtggaatatttcatcccggagtcaagccagacgaggtttgtgtcctgatttaccatgtctacggcaatgtacgccggaagtccggttctcatattatagagccatttcaccggatccgcataggacagaggcgtaacacggtaaggaatacctttgtagttaatctgtgtatagttattcagaatttcaaactgggagacgagttccgtcatctcacccagctttttgcttccgagtcttgaagccgtatccttgtctaccacaggtatctgggacatgttgagttccgatacatcggtggtaaagttaccgtcggtgatggtaatgagatcgcggtaccttgcggcattgaataccttaagtcccagcgcggaagccaggatcatgaaagcgaccagaaccgcaatggcgataaagccgaattttaacggtttccccatattgattttgtttttttcctcgctctgtaccttgcggaatacgacctggcccgtcacaggatctctggtgagttccataccccggccggaactgagattctggataaaatccttgacataggtgagaaagttgaccaccaggaaaatcacaatacatgaaatgagataaataatgaaatttctatctctgaggttaatggccggcagcatagaataaaagagtaagaacatgagaacggccgatataataatcctggttaaaatcgatgaagctttttttaatttcataaattcctcctttagctgatacagcctattgtatccagaaatggtgagaaaatcaaggtatattcgcagaatagcagagtatgcacggaaatttcgggtataggcggtgcaataggccctgaaattgcagctttccgccgatatatgtcataaaacgtcttgccgggcatgaagaatacaggatgtaaggatggttgcaatggatggtgtctgataaattacataataaaatataattaataaaaaatattgcactcactatattgatgtgatataattctcaataaagaactattctttatgtgtactttaattaaagaacgccggttgtattgtgtgctttaattggaaacccgagttttccgcgtaagcggaaccagttgaggaaactcagaaaggatgattgttatggcagaatttgaactgtcgtcagtggaaaaagccgtgaagggacacctcccaaaagctttagagctgagccgttccctgagagaacatccggaacttccggatcaggaatttgaatccagcagaaaaatggtggagatcctgaaggaggcaggctttgaggttacatacccatatgccggatatgagacggcattccatgctctctttgataatggcgacggcccggaagtggcaattctgacggaatacgatgcacttccggaaataggacatggctgcgggcacaacctgcatggttcactctccatactgacgggacttgcacttaaggatctgaaggattcctataaaggaaagctgcatgtgatcggcacccccgcggaggaggagaacggtgcgaagataggtatggccgcccagggcatctttgacaatatgtccctggccatgatgatgcacagctggtcgggaggaaagtgccgggccgatatggacgcgctgagcctgcggtgctatttcgtggaattttacggccaggcagctcatgcggttgccgcgccgtgggaaggcagaagcgctctggcggcggccagaaagttcctggatctgattgatgcacggcgtgaatgctttaccccggatgtccatgtgaacagcatcgtggtagatggaggaaaagcacccaacattatcccggattatgtgaagctcagaatggaattcaggactgcaacaatgaaatccatgggcgccgtagacgagatggtgaaaaagtgtgcggacggagccgcgcttgccctggactgcgccgtaaaattcacaacggtattcgagtttgccgacatggtgcggaacatggcgttggaagaggaggtggtacgacagtttgaaagctttggcatgcccacaacaggcgtggaggccgccagcggttcctccgatgtgggaaatgtcagctaccggtgtccggccatacagccgctgctggccatcacggacgaagattatgcattgcatacggcggcattcagagatgccactgctttgccgcaggcggagcaggcaatggaaaagggggcatgtatcctggctttgatggctcttaagatatttaatgatgaagcgttcagaaacagggtttatgcggagtttcaggagcaggtggagaagaggagataacctggtctgtctaagagaggagagattatatgagtagtgggtctgtaaccaaaaagaaaaaatttaaaatgcctcatatttatgtacttcttattactataatcataatttgtgcgattgcatcctggatcctcccggccggagagtttgaccgggcgctcaacgatgccggaagggaaatggtagttccgggtacatatcacataatcgagtccacaccggtaggcttcttcacccttgttcagtcaatttataacggtaccgtcgatgcggcaggcgtaactttcttcgtttttatttcttatgcctccatcggcctgattattgccagcggagcttttaacggccttgtcgccagtatgctcagaatattaaagggatccgcacgcgccgttattatccctgtatttatcacactgataggatgcgccagctcaaccatcggcgtatttgaggaaatgttcccgtttattccgattttcgtcggaatcgccatagccatggggtatgatgccattgtcggcctggccattgtcgctttgggcaccggcctgggctacagcggggctgtcatgaatccgttcacggtcggcatggcgcagagtattgccgatatccctcagatgtcgggcgccggttacaggattatatgccatgcggttatgattgcagtcgcttcattctttgtgatccggtatgcattaaagatccaggccgacccgacaaagagccttgtttacggcgatgatttcagcagtcttacgatggattcggatcacattgaaaacaagcagtttggcatcagggaaaaattggtccttgcgactctcgttgccggtattgtggtaattgtatggggaacaaagacaaaaggctggtattttgcggaactgagtgccgtattccttttgatgggactcgtaagcggttttatcatgggctggggaccgaatgagatagcggagaaagtggcaaagagcttctccgaaattgccgttgcctgtatgatgataggtatagcccgcggtattctggtggttctccaggcaggccatattattgacacgatcgtatattacctttccatcccgctttcaaatcttccgggagccatctcggcgattgcaatgttcctggttcagaccggaatcaacttcttcatcccgtccggttccggtcaggcggtgacgagcatgccgattatggcgcccctggcagacctgattggtatctccagacagtcggccgtattggcattccagtttggcgacggcctttccaacatcatctggcctacgtcgatgacgccaattatctgcggtattgcaggagtaaagattgagaagtggtggaaatggtttgttccgatttttatcgctctcgttataacccagagtatcctgatggctgtatctgtagttgtctggtaactcaaacaaacagcccggagcagcttccgggctgtttgcttaactgatggcggaaatgaattttcagacacgctctaaggcagtacggccgctttatacgggcacgccggctgcccgggccaggttcagagtccgcacggcaccgtcatagaatgcgatatccaccatttttccatctacggtaaagacgccgattccctgctccttctgttcgtcgattgccctgataagcttttgggcataaataatttccttttctgacggggtgaagatctcatttacaattgcaatctgctttggattaataatcgattttccgtcaaatcccatcatgtgaatagtctcgacatcttttctgaaaccttccatatcatccaggttcgtataaaccgtatcaaaacattgaattttagcagccctggctgccaggatcataagctgcctggctcctgccagttccacccctgtccctgtaatcgaagtctggagatccttcgtgaaatcgcctccgctgagcgcaattccgaataaacggccggaggaacggcagatttccagggcgtttaatacgcctgcggcggattccagggccgccatcagcagagtgctgccttcggggcgtccgaattcctgttctgctgccagtacggcttcttcagcggccttcacgtctgccgcagattctgttttggcaatccggattgcgtccgcgcctgcagccacgcagacccggatatcttctctccagtaaggcgtatccagtccgttgattcgtacaacacgctccacaccgcggtagtcaatttccttcagggcatggtacagcgaatatcgggctgaatccttctgattcgcggcgaccgcatcctccagatccaatatgatggaatccggctcataaatatagggatctttaatcaggccgggcttttggcaattcagaaacatcatggttcttctaagtctgtttttatccggattcatcgaatggcacctccccagggcagctgttccgtgatatggcaggagcggaagacggcgcattccactcttgctttcagggtgcagtcgagagcgcccttatctatcacgctgatttttacatttttaacatcaaggcgttccagcatttcaagaattgtctttctgatctgctttccatactggtttatcacgctgctttccaatataagttctattcctttagccgcaggttccaccatcacctgggcgtcgctggactccagcgtgccggcgatagccgtattcactatttccataaaaacctcctcctgtaatcgtctgtgttatatttattgtttcatttactgtgattatactgaaaagtatccggaaccgccaatattaagattagatatcagatattagaaaaactgatagggtgcatgtgggaatccatattgttcaaatcaaaaattatctgatagaatgaattcatcgaagaggccggaatacatggggaaacggccgcttaatgacaagaagaaaaagaggaggagttcaaatgaaaaaaagagtagcagcactaacaatggcagccgttatggcagtatcagcagcgggctgcagtggcggggcgaaagaatccggttcccagacagaaacaaaagaagcgtcggcgcagtcagacaaagacagcggggcgaaggaagaggaaagcacctggccgcagggtgaaactcttacgattattgttccgttcaaagcaggcggaagcgcagatttgatggtcagaggcattctgccgtattgggaggaaacagccgggtgtacatttgtggtggagaaccgggaaggcgcatccacgatggtcggttccgtatattaccagaccttgccggcggacggcaccagcatctactgcggaacgcagacatatctgagcggcaaccaggtattgcagggggcgacctatgatattaccgattttgatcttatcaatatgcagcagatcgacccgacaacgattaccgtgctggacacttcaccttataactctatcgaagacttgatcaaagccattcaggaaaatccgggcaaaatcaaagtcgggctgacggccggaggagcaggctccattctgcttggaatcctgacggaggcatttgatctggattataagaccatctattatgacagcggcaatgatttccggactgccctgatgggaggccatattgattttatcacaggctccgctaacggcgatatggggcttggcgatcaggcaaaggttctggccgtttgcggctctgagaggaatgcaatctggccggatacgccctgttttgatgaagtttatccggatttgaaaattccgggctccctcggctcctgccgtctttttgccctgcaaaaaggggtgaaggaaaactatccggagcggtatgagaagctggttgaaacttataaagcggcttttgaaaatccggaataccagaagttcctggaatccggcggggaactggccgtctcggcgtaccgcggcccggaggagagcaacaggctgaatcttcagcttcatgagcttgtagtacagtatcaggactggctgaaagaagaataacaggcaacggaacgataacctgtacgctccgcgcacaggtcaccgtattcaatgaatctgcccggtatccatggatgaaggataccgggcagtccagacagaagagaaagaatggacggaaaaggaggactgagaatgggttcgctcataaaaaaactggcgcttcccgcaatcgttttactctggtcggcagcctactttattgaagttgccggttacagtaagaaaaaccagtatttgatcaaaccggcatttatcgtgatggtcattttatttgtggtcaatacatttatcgatataagggagtggagaagagaacaggaatcaggaaagggagcttcgcagatatcgcaggaagaaaagcagttactgcttaaatcattattggtagtggtctctatggcagtttatgtgattttaatgcctcatattggttttatcattacaacggcggttttgctggtagtgctgctgctgattatgcaggtgcgcgagttcctgcctttgattttgctgccgcttattgtaaccgggattttatatgctgtgtttaaaacaggactgcatattccgctcccggccggatttttaggtttttagggagggcaaaagatgcaacatttcattgaaggattttcggtaatatttcaaatgcagtatctgttgtatatgttcggcggtgtggggattggactgatcctgggatgcctgccgggcctgacgggaagtatggggatcgcactgatgctgcctttcacatacaagatgccgccgcttacggcgcttgttttcctgctttctatttacacgggaggtttgtttggaggcgcagttacggctgttatgattaatacacccggatccaccgccaatatggtcacaatgctggacgggtatccgatgaataaaaggggagagggcggaaaagcgctcggaattgccctgatgagttctgtaatcggcgggctgataggctgtattttcttattgttcgcaacgaaaccactggctacgttgtcactgaaattcggtccggcggaaatgttcatggtggcgatattcggactgagctgtgtgggcagtctcgcaaagaatacactgaaaagcgtgtatgcaggcctgtttggcattctgctcggaacaattggaatgagttctcttgggactatccggggaacctatggaaacatgtttctgatggacggtattccaatggttccggccctgattgggttcctggccatgccggagattatcaatctggcaggaaaaaagatgatgacagataataacgggaatcactcaaccggtttcagagcagttctttcaggctttaaagaggtgctgaaacgccctgtgcaggcggtgctgtgttcacttttaggcgtggttatcggaatcatgccggccgcaggcgcagccgtcgctggaatgatggggtacaaccagtcaaaacagtggtgtaaaagaggggaccagtttggaactggcattccggagggcgtaattgcctgtgagactgccaacaacgcatccgagggcggagcgctggcgactctgttcgtattgggcattcccggttcggcttctactgccatgatgctcggcgctctggtacttcagggatggaatccgggaccgaagctgtttattgatcatgaggacgtcatttatatggccttttcttccctgttcatacagcagtttgtcatgctgattttgggactggtactatgcgcctttgccgcatatattgtgaaagtgccgacaaaatacctggttccctgtattcttgtgctgacccttctgggggcgttctctaacaggaatacgctctttgatgcaggacttatgctgctgtttggtgtgataggatgggcgatgaaaaaagcagaattcccgatcatgcctttgatactgggacttctgcttggaaaaacggctgataatgaattgctccggacaatagaatcctatgacagtttctggcagattttcaccaggccgatcgttctgattctggcggtcgccagtatcgcctgtatctttggccccatgctggcaaagaagaggaaggcaaaggcttaagacatgacggaaaactcaagtgcgctctaaggcacctgtttaccgggagccagcagccgcgaggccatctccacaaacgccatggtggctttcgaacggtaggtattgggagggaacgcaaagaccagcttgcggtaaagcccttccctgccgatggataagtaggacagcttatagcttccgttatagactggatggatgtaggagcctgccataaaggccagccccagcccctgctcggcaaggcggatactggtctccgggttctgggttttctggatgacatgcggtttacagccatatttttcaaactggctttccgccagagtgaacagccgctgtcctttcgaaagcaggataaagggctcatccatcacgtcttcaaaatttatatagctgcggccggtttcctcatcgcgcattgcccgtttgagaacaggggattccctgttgacagccagatagacctcttcttcgtaggcatcctcggtgggcagctttttatttatcagtggataagttaaaagagcaacgtctatcacctggcgaagcagataatcctccagagtctgggtgttggcttccactgtatgtatcgtaatctgagggtatttcgcatagaaagccggcaggatgtcaggcagtacgaacgaacccctaaacggcgtcaaccccagggagaccttgccggtggagagattggcaatatcccacagctcattttgcaaattgttgccgatggcgactatctggtgcgcggcttcgaggacacgttctcccgcttcggtgggccgcatccccgtagaggtgcgcacgaacagtgagcagccgatggccgcctcgtagctttttagaaactggcttaaggaggactggctgacgaaaagcttttcagcggctttcgacaggctgccctcctcggcgatagttaggatgttggttaattcccggaactccatgtgagcgttgacctcctttgcgtgaaaacaccctgcggctcgtggttgtgattgtaagtttaacactggttcgtcaatatgcacaaaaaatgttgaaaattgtcgaataatatttacagataatcatatattgtttatcagcgtaagtcaagaaaaaataaatggaaaaaaatagtatcattatttagccgtaaaagttcagatagtatgaactgttacatttagcaacagattgttggaggatagatagcatgattaacaaggttggaagagatataccggatgaaattttagagcggtacgggaaagaagggtataacggcccggattaccgcaacggtacctattatgtgaaggctgcgccgagggtacgcagccgcatggaaggttccggaaagattcttccctccctgcaggaggcattgcttaaatgcggcgtcagggacggcatggttctttcatttcatcaccatttccgtgatggagactacgtggtgaatctggtgatggagacggtggctgccctggggattaaagacattacgatatgcgccagttccctgggggcggcccatgatccggtagcgaagctgatagaggagggagttgtaaccggaatccagtcgtcgggagtgcgcggaaaaataggggaggccatatcgggaggcaggcttaaaaatccggccgtgatccgctcccacggaggaagggtgagggcgattgaggaaggcgacgtccatatcgatatagcatttatcggcgcgtccaccagtgatgaatacgggaatgccaggggcgtgggaggcaagagcaactgcggcgttttatcctactccatggttgacgccaaatatgcggatcatgtggtggtggtgaccgactgcctggtggaatatcccaaccttccggccagtatatcacaggtagatgtggattatgtggtggaggttgaggcaattggcaaccccgataaaattgtcagcaatgttgtacgcatgacaaatgacgtaagagagcttaagatggcggaatactgtgccagggttatcgcaaaagctccttttttcaaagatggattttccttccagacggggggcggcggtgcagctctcgctgtgaacagaatgctgcggccctatctggaagaaaaaaatatcaggatgggatttgccatcggcgggattacacagcctatgtgcgagcttttagaagagggctttgtgcgcaggattgtggatgcccagtgctttgatgcggcctcggtgaagtcggttgaaaacgaccccggacattttgaaatatccacatccgaatacgctaacccgatgaataagggcgcttacgtcaaccgtctggactatgtggtccttggagcgcttgagatcgatttggactttaatgtcaatgtggtaaccggttccgacggagtagtgcggggggctcccggcggccatccggatacctcggcaggctccaattgttccattatcgtagcgcctctgctgcgaagccgtatcccgacggtctgtgacagggtagtgacggtgacgacaccgggggagtgcgtggatgtgcttgttaccgattatggcatagcggtcaatcctttgagacaggatctgcttggggccttccgggaagcaggacttcccctgaagacgattgaggagcttcgcgatatcgcttattcgatcgtcggagagccggaaccgctggaatttggggagcgggtggtaggaattgtggagagccgggatgggacaattctggacgtgataaggcagataaaagactagggtctgtttgaaaatacataaataacaaggtggaatttgtgatgagaaaagaagataagggagtctatctggtaaatggaaaccggattgtaagcagcgaagagaaacctctcctgaccggcatcggtttcaccgaggcggagcttaagacggcaaaagaggggacaatggcctggtcgatactgaaggcccataatacttcatcggatatggagaacctgaggctgaaatttgatgcgcttgtaagccatgacatgacatatatgggagtgctgcagacggcaattgcctgcggtgtggaagaatttccgatcccctttgtccttacaaactgtcataacagcctgtgtacgcttggaggaactctgaacgaggatgatcatctctttgggatgggggcagtaaaaaaatatggaggaatcatggttccggcccaccaggcggttcttcaccaatatatcagagagcagctggccgggggcggaaaaatgattctgggggcggacagccataccagatacggcgcgctgggaacaatggcagttggggaaggcgccggcgagctggtgaaacagcttttgtgccgcacctatgatctggcaaggccccctgtggtactggtatacatgaagggaacgcctgcggccggagtgggtccgcaggatgtggccctggatataatacggaatgtattttctgatggatttgtaaaaaacagaatcatggaatttgcaggcccgggaattgcaggcctcagcatggacttcaggaacggaatcgatgtaatgacgacggaatcctcctgcgtttccacgatttggcagacggacagtacggtcaaagactggctttccgtacataaaagagagaatgaataccgggaaatccgtccgtcccgacttgcctactacgattatctgctggaggtggatctcggcgaggtgaagccgatgattgcccttcccttccatccgagcaatgcctatacaatcgaagaggtgaatgaaaatcccgaagatatcctgcggctgacagaggaaaactgcaatgcgcagatgaaggaattcggcctgaagatggatttgaggagcaagattgaacacggccgactgagagtggatcagggagtaatcgcgggctgtgcgggcggaatgtttgaaaatatcagcaaagccgcggatattctcaaaggcagttccatcggaaacgacatattccagctgaatgtttatccggccagccagccggtattccaggaagtggtggagaaggggatagcctctggcctgctcgaggcgggagccaatcttcgctccgccttctgcggcccctgcttcggggccggtgatgtcccgtttaacggcggattttcaatacgccatacaacgcggaacttctcaaaccgtgaaggctccagaccaaagagcggccagcttgcatcggttgcattaatggacgcgctgagcatcgccgcaacggcagccaataaaggattcctgacaccggcgacgcagtgggagggaagcttcacaaagcatcagtatcattttaatccgaagctgtatgagaacagggtgctgaactgttttggtaagccggacaagagcgtggaactggtaaaagggccgaatatcaaggatatccctgtaataccgggactgaaggaggatttgctgctcaaggtttccgccgtgcttaccgatccggtgacgacgactgatgaactgattccgggaggggaaagctcttcctaccgctcaaaccttttaaaactggctgaatatgccctgtcggcccgggaaccgcagtacgtgggccgctgcaaggaaatacagaagtgggagtcggcgcttatggccggagataatccatttgaaacggaggaggagcttaagacggcagcagaatacctgaaaagccggggactgtctttacagacagacaaaacctgcgtcggaagcgtcctgtatgccaataagccgggagacggttcggcaagggagtatgcggcaacctgccagcgggtgattggcggatgggccaatatctgccgtgaatacgccaccaaacgataccgctcaaacctgattaactggggcatcctgccgtttacctttcagggggagccatgctttaaaacgggaagccttttatgggttcccggcatcagaagggttcttgaatccggcgggagtgaagcagaggcatttgtgattccggaaagccgggaggaaaagccggaaaaaatcacgctttccctcggaacgctgggggagacggagcgccgcatcctgctggagggatgtctgattaattattataaatgcgggggccggtaaggctctggacataggacagacaaaaggagactcatcatcaaagtctccttttgtatcttttcactgcagtcaacggcagtttttaccgtttctgcgcataatttacagccgttttgcctgaggctgaacggtaactttaaagtttgaaatccagacggtaaatgttgacgggacggcctttgaccccattcctttttttgccgcataccgaggcgtatccgccctcttcgagatgggacaggtatttattcgcgctgcgcagtgatattccaaggctgttcatcaaatccatggatgtaatttcttccgtttccagagaattcaggacttcggcaattcggaccacggtttcagcggatagttttaccttatctgcgatttgggaaatcgccttgacggagaaggcggggcctgtctctgaagaagtaccggcggataaaaaggtaagggattcgttctgattaaggaggaagctgcctgtattatccttcatccggctttgtccgtaatggctggcattgatggcattcaggcgggcctggtatatattgtcgccgattccatatccgacggagccggggaaatcaagtccttttatcaaaatgggaaggagcgggcatatacggaagccttccgtcagattctccatggtttcatagtccatataaagctccagatcatcataattggctttgaagattgctttattaaaatagcgctggttaaactgtatcaccacacgaaccagttcaaggcggaacagctcatatttatccttatacatctccctggctttctccgtattgatatggatgacggcagagcggtttttgttaaactttttaataaaaatgctcttttttagttcctcgatgctgttccagaatgcccattcaccgcggtaaacgtaatagcaccggatattcttatctttcaggcgttccagcacactgtaatagtaggtgatgataatatccagcctgccttccatatactgcttttcatagaaatcctgaacacgcagctcctccagttcgatttcctcaaccgactgcaggctgctccagcgtttttcataggtataagcggcctgtgcaaatttctcttcgcgtatcaaatcctccagcgttttcttatcgtcaaggaaatccattcccacacgtgagaggttcacgttttcaatgcctgacgttataatgtggtgaagcagcgcctggtaaacattttcaacattgacggaggagtgggcgataatggcatccttgctcttttcaccgaggattttaatcgcctgcagcgggatcaggccgctgacataaaagccgtcgtattgatttttaatagaaagaaaaatatcctgtatgtcctggattgttttatacgggaagaagtcgaagataacgtcatccggtttgttcggcatgtaactgtttatcttttccctaaaatgttccttaagaatcaaagcaattttaaataccattttttctcctttttgttcgaaatgggcaggtgtaaagagggaaaggtacatatataaccttattttataaatatagcagatgggacttaagaactcaagcggctttgcactgcctggacgtgactgttgagaagtatgtggagatttaactgaggttgggaggacgcgtccggaacggaccatgtccggtgtggtgagggggatggctgagtcttccgtccccgtgggaagttggttgtggagggggaatccggccggaatgaattgctgcggggaccgtttgcactctttggagtgcgcatcagtgctaagctcgtgaaggacctcgctaagcaccggcggactcccatgtcccctccgcaattgattccgcctacttccccggttcaggttatcgcagggacggaagactcaggcggaagttttcgcggcaccggacatggtccgttccggacgctgattgtctctaaccttaaatggggaggaccctgtcgcggccactacgtgtttccggcaggccgatatcaaatcttccacaattccttaataaaggtgcattgaaagcatatcgtatttcccgcacacggaagcgctaagtggtctcgacaaggtccgcccccgcacttaatgcgtgagacaatcagcggccgcaggccggcggacggggccgatacacttggcggagtctttcgttccggcgaaaatctggccttggggcggaggggaagataaagtctgcggatgccgttgaaatccatcgctgattagcgaggtcccttacgagcttagcagcgcgatgcatttcacagagcgagagcgtgctccgcagactttatcttcgcccgtagtcccaactcacaacaatcttccccgggacgaaagactcatatacacaccccaccaccccgtccgctggccgtaccggcggcgtcctcacctgcttaactaaatctctattatgtagtggccgcgacaaggttccctccccattgaggctggagacaatcagcgcccggagcggaccatgaccggtgtgcgaaaatctccgcctgagtcttccgtccctgcgaaaacctgaaccggggaagtaggcggaatcaattgcggaggggacatgggagtccgccggtgcttagcgaggttcctcacgagcttagcactgatgcgcactccaaagagtgcaaacggtccccgcagcaattcattccagccggattccccctcacgacatcctccaaccggggacggaagactcagccagccccctcaccacaccggacatggtccgttccggacgcgtcctccattttcaataaatttcactttgcagacacaaaagaaattcctacttgacaaataaaagagatgtgctaaaatattacctaagtttaacagaaatccctatagaaaaaggctgcgaaagtgtcagtagaatcttatttcccatcagagagaaggaatcaccggctgtaagttccttcaggttcagataagtgttcgaatttcccaccggagctgcatggccgaaccgtgatacattcagtaggctgtgacggatcatacacgttacgtataagataagagcctgcatggcaggaaacagggtggtaccgcgagcttgatgcctcgtcccttcgcaattgcgaagagacggggctttttatgttgcagacggcgtaatttatctgtgggccgtttcaaattcacacttcaaaaaggagtcaatatgagagagcaattagaaaagattaaagaagaagcgttaaaacagattgaagcttccgatgcgctggagagattaaatgatatccgtgttgcttacctggggaagaaaggcgagctgacaagtgtattaaagagtatgaaagacgtctcgccggaggagcggccaaaggtaggacagatggtcaacgaggccagagcgctgattgaggcgaagctggaggagacaaaaaacgttctggccagaaaagccagagaagagcagatgaaacgggaagtaatcgatgttacgcttcctgctgaaaaaggcaatgtgggacacagccatccgaataccattgcgctggaggaagtggagcgcatttttgtgggcatgggatatgaggttgtggaaggcccggaagtggaacatgatctgtataactttgaaaaactgaatattccggcaaaccatccggcaaaggatgaacaggatactttctatattaataaggaaatcgtattaaggacccagacatctccggttcaggtacggacaatggagcagggaaaactcccgatccgtatgatcgcaccgggacgcgtattccgttccgacgaggtggatgcaactcattctccgtctttccatcagattgagggacttgtaattgataaaaacatcacatttgccgatttaaaagggacgctggctgaatttgccagggaattattcggaccggagacaaaggttaagtttcgcccccatcatttcccattcacggagccgagtgccgaggtggacgtaacgtgctttaaatgcggcggaaagggctgccgtttctgcaaaggctccggctggattgagatcctaggctgcggtatggtacatccccatgttctggagatgagcggcattgatcccgaggagtattcagggtttgccttcggtgtgggactggagcgaattgcgctgttgaaatacgagatagacgacatgagacttttatatgaaaatgatatccgtttcctgaagcagttttaatgagcggataagagtaacagttcagacaggtctgcgcatttgctgcgctgaccgtgcggaaatgtagtggcagcaagcatccggctcatcgcgcagcgattttattagccggatgccgtaacagttcatgttgtttgaaatgttacggattagatgatgaaagagcagaggagatagaaatgaacacagcattatcctggattaaagcatatgttccggacttagacgtaacggctcaggagtataccgacgccatgaccttaagcggaacaaaagtagagggctatgagtgccttgataaaaatctggaaaagattgtggttggccagattacaaagatagaacgccatccggatgcagataaactgattatctgtcaggtcaatgtcggagaagaatccatccagatcgtaaccggagcgccgaacgtgaaagagggggataaagttccggttgtacgggacggcggccgggttgcaggagggcatgacggcggcccgcttccggaagacggaatcaagattaaaaaaggaaaactcagaggaattgaatcatacggaatgatgtgttccatcgaggaactgggatccagccgtgaaatgtatccggatgctcctgaatcaggcatctatatcctccctgacgattgtgaagtgggtgcggatgcggtggagattctgggactgcgcgacgtggtatttgagtatgaaatcacatccaaccgcgtggactgctacagcgttatcggtgttgccagggaggcggctgccacatttaataagaaattcatgcctccggttgtgacggatacgggaaacagcgaagatatccatgattatctggaagtatccgtggaggataccgggctttgtccgagatactgtgcaagaatggtgaaaaatataaaaatagcgccatcgccggtctggatgcagagacgtctcgctgcaagcggaatccgtccaatcaacaatattgttgatattacgaattacgtgatggaagaatacggacagccgatgcatgcatttgattacgatcaaatcggcggtcataaaatcattgtaaaatgtgcaaaagacggagatgtgttccagactctggacggacaggagcggaagctggacagccgtgtcctgatgatcaatgatgcggagaaggaagtgggaattgccggaattatgggtggtgaaaactcaaaaatcacagataatgtaaagaccatggtttttgaggcagcctgctttgatggtacgaatatccgtctttcctcaaaacgtgtgggacttcggaccgatgcgtcgggcaaattcgaaaaggggctcgatccgaatacggcaaaagccgcaatcgaccgcgcctgccagttgattgaggagctgggagctggtgaagtggtaggcggaatcattgatgtctatccggtaaaaagagaaggcaacagagtgaaattcgaaccggagaaaatcaaccggcttctgggaacggacatcgcggcagacacaatgcttgaatacctgggacgggtggaactggactatgataaagaaacgggtgaagtgattgtgcctagctggagacaggatatacactgcatggcggatctggcggaggaagtggcgcggttctacggatacgatgtgattccgacctctctcccgaccggtgaggctacaacaggaaaactgtcctttaagctgagggtggaagaagtggccaggaagattgcggagttttcaggattcagccagagcatgacttattcctttgaaagcccaaaggtatttgataagctgatgcttccggcagacagcgggttcagaaatgcaatcacaatctccaatccgctgggagaggatttcagtattatgcgtacactgccgttaaacggcatgctcacctccctgtccaccaattacaacaggagaaataaagatgtgcgtctctatgagctggctacgatctatattcctaaagagcttccgctggccgagcttcccgacgagcgccagcagtttacgctgggcatgtacggcagcggcgacttctatacgatgaagggtgtagttgaagaatttttcgacaaaatcggaatgaagaaaaagccgcattataatccggaggcgggcaaagcattcctgcatccgggccggcaggcggagatcatttacgacggaacaagtgtcggatatctgggggaaatccatcccgatgttgccgataattacaaactgggtgagaagacgtatgtggcggttctcgatatgccgtccatcctgcccaatgccacctttgaccataagtacaccggaatcgccaaatatccggctgtgacaagggatatcagcatggtgatgaaaaaagagatcctggccggtcaggtggaagatatcattgaacagagaggcggaaagatcctggagagctacaagctttttgatatctatgagggtagccagatcactgccggttataaatctatcgcttactcaatcaccttcagggctaacgatcacacgctggaggataaagaagtaaatacggttatgaataagattctgaacggcctgcaaggtcttggaatcgaacttagaagttaaatcaagcaggtaagaggcacccggccacagctgattcgtcagccatggccgggtgcctctttttgaaggcagcggcctgtgcggagcgggcaggttatcgttgtaagaaagtgacctgaggcggagcctgcaggttcggctatcgtctatacaaataaaaaacaagtttcgaaatttgtaaaattttacttatatatgataaaaaagtagaaaatattgacggaacaggtataaaaagtttataattatttgtaaatattgctgtcgaagtatgccggcaaagacacaaggtgaggaagctatgggaagaatttcaaacaaagaagataccggaatttatattatagatgatcaataccgaatcgtatactttaatgacaaaataaggcagacatttccgtttctgtgctgcggggaacgatgttacgaagcgctttgccgggaagaggagccatgccgtgactgcccggttgcgaaggatgaggcgaagagcggggtgctttataacaaggtgacccagagatgggtggaggtcagcgggggaaacatcgaatggccgggccatggcgactgcaccatggttatcacgaccgggattcgcgaggttaataagaatttattttataatcttaccagtatatcggcttacgatgaattgtttgaattgaacctgacccgggatacgtataaaattctctatcatctggcagggaaatatgtgataccggcagaggagggctctctgggggcgatgctggacgaggtagtcacgcagatgatccaccctgacgacagggaggaatttctggaattctggtccctggacaggatggcggcatgtctgcaggaagagggggaggaccatatccttaaaaaacggctgcgtaaattaaaaacagacggaagctactgctgggttatccagatcgtagtgccgcttatccagggagagcatgacgacaagatcctgatgtgctttatccaggacatagacgaacagatgcggaaagaagaggagctgtcaggaaaggataaaaatgcagacgggaaggatccgctgacgggtctttaccgccgttcggagttcttccgtacggcagagagttttctcagggagattgaggataagagctactgcctgatggttattgacattgaacattttaaattatttaaccagtggtacggggaagcagagggcgaccggtttttaattaacattgcccagcatctgaaaaaagcccaggatgagaaccggggaatcgccggttatatggggggcgacgattttgtgatcatattgccggatgacggaaagatgcttgagcgtcttcagaataagatcatggggtttgtgaagctgtacggtaaaaatgccggttttcttcctgcatttggactgtacgccattgaaaataagaatattccggtcagcacgatgtacgacagagctacggtcgcgctggcctcggtaaagggcaattatgcccaccgtgtctgccggtatgacagcagaatgcttgaaaagatggaggaggatcacctcctgctttcagaagtgcagcgtgcgctcaataatgatgaatttaccttttaccttcagccgcagtgcaatatgacgaacggaaagattgtcgggctcgagacactggtcagatggaaccatccggagaggggggtgatctcaccgggagagtttattccgcttctggaaagcaacggcttaattgccagcctggaccttcatatctgggagaatgtctgtatcaggctgcgaagctggatagacagcggaaaaaagccggttcccgtatccgtcaatgtctcaagggtggacatttacacgattgatgttgtggaatgcttttgcaatctggtgacaaaatataatctggatccgagtctgctggaaatagagatcacggagagcgcctatgcggagcagtatgatatttttacaggcgtaatagagaatctgcggtctgccgggttcctggtattcatggatgatttcggaagcggatactcctccctgaatatgctgaacgacgtcaaggtggatgtgctcaaaatcgacatgaagttccttaaaatgtatgaacaaagcccgggcagggggacgggaatcctggagacaatcatcaatatggccagatttatggagcttcggatgatcgcggagggagtggaaaccagggaacaggcagagcttctgctggatatgggctgtatctacgggcaggggtattatttttaccgtccgatgcctgcgccgcagtgcgaggtcatcctggcggatgaagataatattgatttccggggaataacggcaaaagccattaaccggatacaggccagggagctggtgcatgatgatatcttcagtgagactatgctcaataatatccttggcggcttcggcctgtatgacatgtccggaaaccaggtggagcttttgagggtaaatgagcagtactgcaaaatcacagggacaagcgcggtggagctggaagagcggcataaaaatgttgtgaatgatgtttaccaggaagacagggaggagctttttaaaatctttggagctgcctgcaaagacagattccggggaggggaggggagggggaactgcggtacctgaaaggcgacggcagcatcatgtggatgcatcttcgggcctttttcctgagagagcaggacggacacaggctgttctacggttcggtcagcgatatctcacagcagaagcggaaggagcagcagcttgaatcttcccagagggctttggcagccgtcgttaatatctccgacagaaatacggcgtttatgaagctggcggaagaaaacaggagggcggcggcagcgatttttgcccagatgacgccgggaggaatgattggaggatactgtgaagaaggttttccgctttattttgccaactatgagatggtgaaactgctggggtatgattcctatgatgaattatccaaagcgatcggcgggctggtgttaaacacaatccacccggatgaccgggaacaggtggcaaaggatatcggctctgaatattacgcaggactggaatatacgacaacctatcggatgccgaaaaaggacggaacctggttctggacgctcgacaaaggaaaggtggtgcgcgccgaggacggtcgtttggcgattgtcagtgcctgcaccgatatttcggaaaccatgtttgtacagcagcagctttcggagagaaacgcagcgcttctgcgccagaatcaggaactgcattttatgtacaatgatatgccgggcggatatcacaggtgtgccaaatcacctggttttccttttatttatatcagcaaccgttttctggggattttcggatataccagacaggaaattaaagataaatttaacgacaaatttatcaatatggttcatccggatgaccggagcaacgtaatccagggggttgaatatctgaaggagtgtgaggaagtccacgagctggagtacagaatgctaggtaagaatggatatatatgggtaattgaccagagccgctacatggagtacggcggcaagacttttcttcagggagtggtactcgacgtcacggagacggtggaactgcgcaataagatgaaactgcttatgaaacatatgccggagtccgtttatctgcttacatacaggaatgattgtctatattcccaggttctcgccaaaggtttattcagccgctggccctatacagagtctgcatacagagctatgtttgcagccggggtcagtgaaaacgcggcgggaaacggaacggaaagcctggaggagcggctgaaacaggcagttctccgcagaaaaagctttcaggatgtcacctgtatcacggtgcccggtgaaccgcctgcctggataagcctggatgcaagatatatcagtgaaggagcggacggaattgtctatctctgtatctgcgccgatgtcacttatatcaaggaaaaagaacaggaattgtggcttgtgagaaaaaatatggaaagtattctgcgtcaggcagggattaacagtctggactgggatatagaaaacaatattctgtatctgagccaggtatccggcctgccgaaaccagccggcgccgccgaactgggaaaaaatgtcagtatccaggtgatcgaacatttttctgaaaccgcaaaaaactggaatgtggtatctggggagcacagggaagatttccttcgctatatttcccgcgtatatcaaaacagggacaatacgggactcagctgtgaatttgagatacagcgggagggggagaaccggaagtggtaccgggtggtatgcgagacgatatgcagcagctcaggaaaacctgtcaaggcggtcggttactatatcgatattacgagggaaaagaatgcggcgattgagagcagagccaatagaaaagcgctggagctgcttcgcgaacaggaggaacgtctgaccagaatggcggagacggatgcgctgacgggcctttataacaggcagacggcgatacccagaatcaaaagtttcctgagcagtatggatgggcagacagcggccctgattatgcttgatttagataatttcaagctggtaaacgacgtattcggccatgtgttcggggattcggttatcgcaggcaatgcaaaaaagctgaaaagctttttccgggcagacgatataatctgccggattggaggcgatgaattccttgttctatgtaaaaatatctgtgagaaagatttgaacaggaagattacacagatgatagaggacatggttatgagctgtgagaatgacggaaggaaaatgatattttccatttcagccggttatgccatggctccggagcagggaaccggtttcgatgaattatatgagaaagccgatatagcgctgttcgcggcaaagacaggaggaagaggaaccttcaggaaatatgaagtatcgatgaaaaaaacgagatatgaattggcgggcagaaattaatgcccgctgtttttttccaacgaaatattccaggcagcgttcgccggcagaccggttcctttttctggaaattacaggaggcataaaatggggaaaaaaaggctattcttacagaaagaaagtaaatcaggaggcggttagaaatgaataatgaatttgagatagtcagtgtcaaggggcgggagattctggattcccgcgggaaccctacgatagaagcagaagtaacactggaaaatggagcggtgggcagggcggcggtaccctcaggggcatccaccggtaaattcgaagcggtggaactgagggaccgtgatacacggtatcatggacttggagtaagcaccgccgcaggcaatatcgtcaatgtaatcggcgagacggttctgtttgaaaatgcgctggagcagagaaaaatagaccggcttatgatagatgccgacggaacggaaaacaaggaaaaactgggagccaacgcgattctcggtgtttcgatggccgttgcaagagctgcggccgaaggccttcatatcccgctgtaccggtatctcggaggaatcggggcatcgacgctgcctgttccgatgatgaatatcctgaacggcggccgacatgcggacaatacggtggatttgcaggaattcatgattatgcctgtcggggcatccggcttttccgaaggtttgagaatgtgttcggaaatttaccacacactgaaaaaggtattaaatgagggcggatacagtacggctgtcggcgacgagggaggatttgccccaaatcttaaaaatgccgaggaagtgctggagacgatcgtaaaggcggtcgagaaaagcggttatcatccaggctacgacattaaaatcgccatcgacgccgcatccagcgagctttacgatgaggccagcggactgtacctgttcccgggtgagactgcgatgaacggccgggagatacggcgcacggccggggagatggtggactattataagagactgataggcaaattccccatctgttccatcgaggatggcctccaggaagatgactgggagggctggaaacggctgacggatgaactcggtaagaagattcagctggtgggagacgatctcttcgttacaaataccaagaggctcagcagaggaatcaaagagggtgtggccaactctatccttgtcaaagtaaaccagataggtacgctgacagagagctttgatgccatagagatggcgaaaaaagcgggatataccacagtgatttcccaccgttcgggcgagacggaggattccttcatagccgatattgcagtagcggtaaattccggacagattaaaaccggagcgccgtgccgttccgatcgtgtggcgaaatataaccagcttttgaggattgaagagcagctccgataagagtgccggccgtaccgctgtcatttctctctgaacacggataagaagataatgcataaaacctgccgtcaggcagcctggtggaaaagggctgtgtggcggcaggtttttgtatctgataccacaatatttatattgtgaaaatatgaaaataatactgttagacattgacataatttggtgatattatgatcacaaaaatagagaaaaaagaatgaaaaaacatataatattctgtaattacaggagggaagcatgaaaaaagtcgtattaatggactgcacgctgcgggatggcgccaatgtggtcggaaaagggttttcagcggaaatcacggatatggtgttagatggcctgacagcatgccgtgtgccaatcatagaatttggaaatgcaggaggcatcggcgcttatgaggtagccggattcacggcggcggagacggatgaaacttatctggagattgcaaaaaaatatctggacagaggctccgagctcggaatgtttttaaatgcaaagagataccgtgaaaaaaatgtgacgcttgcaaaggagagcggtttatccttcctgagggtcggagctgacgccggggatgccgatatagccgttcaggcagtcaaagacataaaaagcgccggattaaaggctttctattctcaaatgaaagcatatcttttgacgccggaagaactggcggaggaaggaaaaaagctggaagacgcaggccttgatcagataacgattatggattcggctggtaccatgctgccaaatcaggtggcggaatatacgaaaaagttaaaggaggcagtagcgattccggttgcttttcactgtcataacaacctgggcttatcggctgccaacgcggttgctgcctatcaaaacggtattgacattctggactgcggcctgatgggaatggcaaggagcgcaggaaatctggcgacggagatttgcgtggcaatcatgaaccgttatgatcagatgatggagacagacctgtatcagatgcttgattttatcgaacagcgtctgcagtcggccatggcgggatatgattatcataaccctgtgacgcctcttgatttgacactgggtctttccggctgccactccagtttcgtgaaacggttccgggagatttcagaagaaatggatgtcaatctgttccgtttgattgttgaagtatcaaagcaggatcagaaagcgccgtcggaagaaatgattcggacgattgccgctcagataaaaggaggagcctgatatgataaaagttattttagcgggaaattatccggaacagacatacgaaaagttaagaaaactcctgccggaacagaagtttgagctggaggaggtaaatgaacaaagtcaatttgatgcggttacggatgccgaaattatcatcctccggatttttaaggcgccgaaagaggtgtttgaaaggaatccgaagttaaaaatgatcctgcgctggggagccggatttgattctgttgatatagaggaagcgggaaaaagaggcattccggtaaccaataccccgggggcaaatgcaaatgcggtatcggaactgacagtgatgctgatgctggcgctggggcgtaaactgcagtgccatatggagtctttgaagaacggaatctggagcaagaacacatttttgaaccagtcatactgtctgaatcagaaacgggtcggcattatcggcggaggaaacattggccgtcaggttgcggcgaaggtgcaggcctttggcgcttcggttcagtattatgatgcggtccggcttccgcaggagatggaagaacagtggaagatgacatatctgccattggacgagctgctgcaaacgtctgatatcgtaactcttcatgtgccgcttgttgatgagacgcgtcatatgattggggaagaacaaattaaaaaaatgaaagagggggcaattttaattaacacggcccggggaggccttgtagatgatgtggctctggaaaaagcggtgcgtaccggaatgttatccggcgccggtctggatgttgtagagcgggaaccgctgtccgcacaggacgaactgcttcacaatccgaacattattgtgactccccatatcggaggtggaacggctgatttgggagatattataattccaatgctggtaaatgatatcctgagattatcagagggagaggaaccggaacatattgtaaacaagaaatatttcagatgatgaaagtacgaagggagaatgggaatgagtgagattgcaagggttttatatgatttggggattttgagtattttgctgctgttaggtgttttcctcaggaagaaggtacgctttctgcagaatctttacataccggcttcgctgttgggaggattctgcggcttgatgctggggccgcagatcctcggttcatttgcacctttcagccttcctatcggaggcacgatatcaaaatggccgggaatgctggtaaatattgtactgggcgtatcattttttggttcggcacagaataaaaattttggaaagacagcattatctgccgttacggtgggcggtattgcccatcaggcgcaggttgtggccggacttatcgtaaccatcataatgatgacgttctatacggaccttccgctggcatttggcctgacgccggtatttggctttcatgggggccacggaacggccaatgcagccggagcggcgctggaagcagctgggtgggctgatggtgtatcggtatcgaatacaatggcaacggccggtctgctgtccggtattattataggtatgcttatcattaacatcggggttcgaagagggtatgcgaagctcgtttccaaaccgcaggatatttcccgttcaattaaagagggaatcgtaccgaaagaagaaagacgctctatcggttcaggcgtaacctacaatgatgcgctggatccgctggccctgcagcttgcttttgtcggaatcattctgctgatggcccacggactgtctgtcggattagttgcgattcatccgattctcagcaatgtacctgaatttgcctgtgcaatggtcagcggcgcgttcctctcgtttgtgatgaaaaaaatggggattggagattatattgacagagcgacaatcagccgtatttcaggagtggcgcttgatttccttgtatgctcggcgattgcaacactttcgataaaggtgtttgcactttatctggttccgatggtagtgacgattgcggtcgttgttctggtaaatttattcgtaaacttttatttttcatggaaagtcttcgatgaggactggttcgagcgtgcgcttggaagctatggcctggagagcggtgtcctggcaaccggactgatgcttttaagggtagttgacccggaatttaagacaagtggacaggaatcggcagcagcatcagcagcgctttgttatccatggtcgcttccatatattatgtttatgccggcatttgcttttgcggcttcaaaatggaccattttaggtatcagtgtggctcttttagtagtgtttttgattatcgcgcgggtctgcttctggcatccggagcggaaattaagtgatattttatccgggaaaagttcccgtccggtacagaatcaggacgcactgaaataaaacagggtgagagaggagaaatatgcaggagctgattttaaaaaatggatatctctttgatcctccgaacggatatacaggacaaagaggagatgtggcgatacaggatggacgaatcacaggtgtcgggaagatagaggaagaagcgtcccagacagtggatgtaaccggacttgccgtcactccgggattgattgatttccatgcgcatttttaccatggcgggacgaatacggcgctggagttttaccggtacctctcagatggcgtcacaaacgcagtcgatgcgggcagcgcaggtgactccaatatagagagctttatccacttattgagcgagcgtgagcgcagaaatgtgaagctctatttaaacctggcctcagagggactcagctgtctcggagatcacaatgaaaatataaatccaaagtattttaatgagcaaaaaatacttaggatatgtaaacgatattccgatctgattgccggccttaagcttagaatcagcgcagagattgcaacggacagtcaaaccaccagctttgatgcgctgcggcgggggattgaaatcgcacagcgctgcggacttccgttatcggttcatatgccgaattttcaaggggaattaagcgggctgattgatatcttgcggccaggggatattttttgccatgtctatacacctcaaaaagggatattggaggatggaagtgtttcagaggaaatgaaacgggcggttcaaaaaggcattatcctggaatctgcatgcggaaaaggacattttggacacgaatgcgcaggaaaagctattcaggcagggattgagccaaatataatttccggagattttacaaaaaacacccatcattttgaaccggcagtttccctgccttacctgatgtcacgatttctgggactcggactgtcttttgaaaaagtgctttcgtgctgtacaacggaacctgcaaaacagatgggcatggaaggaaaaatcggctgccttaaaacaggcgcctttgccaatattgcagttttagagagaagacagaaggacattgtgtttgtggatgtcaagggaaaagaggtcagaggaaacgagctgattattcctgtaatgacaattttagagggagaacctgtttaccgtaatatgagcgccttttagagaactgtgataagcagttggggatgacgccggtacctgccttcacgacaaaatatatatttcaaacaaatggttgtctttcaggaaaaaatatggtatgatacagttgtttgactataggaggtgctaaaatgataagaggtattctcacctttttattcgttgcgatttgcttatttttatcagtagtaatcttacttcaggaaggtaaatccgcaggcctgtccggttccatcagcggtatggcagacagctactggggaaagaataagagccgttccatggaaggcaagttggagaagatgacaaaatatggtgcatttctctggctggtgcttgcatttatattgaacctgaaagtattgtaatccggacactcctggcagcaggggtgttttttctttacaggaaaggaaattttgtattttattgcatgtaaccggagaatttcctgcataataagaaaaagaaaactaatggagaattaaattgaaaatcaaggataaaattaaaaagaaattaaaacccggaaaaaagccggggaaacacacagagcgtatcagttcccgcactgagaaagacagagggcgggagaggacgggaagtgtgccagcagatacgaagaaccgagaaaagtccgggggcagggagtattttgagcctgaaaaggatgcggaatttctgagaagaaagcagatgattctggcactgatgaatgacaaagcctacgtccccatgaagatgaaggaactggcaatacttctcgatataccgaaggaacagagaagggaacttaagtctgtgctggatgcgctgttaaaggaaggccagatcagcctgtccgcgaaaggaaaactcggcaggccggaaacatttgccctgacgggtatttttaccggccactccaagggatttggctttgtgacggtagaaggaagagaaaaggatgtcttcattcccggtgacaggacgggcggcgccatgcatggcgataaggtgcagattgtcatcgaggaggaagataacgggaaacgggcggaaggctgtgttgtccgtgttctggaacatgccaatgataatctggtcggtatctatgaaaagagcaagggattcggttttgtgattccggataaccagaaagtttcaaaggacatttttattccccaggggtgtgacgcgggagcggtgaccggccataaagtggttgtcagaattaaagatttcggtgacggtaagggaaagaagcctgagggtgttatcacagagattctggggcatatcaacgatccggggattgatatcctgtccattgtgcgggcctataatctgccggaggagttcccggaagcggtgacggaacagttaaagaggattccggatcaagtgctgccggaggagctggcgggaagaaaggatctgagagaacttcagaccgtcacaatcgacggggaggaggcaaaggatctggatgatgcgattacaattaaaaaaacgcagggcggatatgaactgggtgtccatatcgccgatgtcacccactacgtcagagaacacagtccactagacgaggaagcgctcaagagaggaaccagcgtgtatctgaccgaccgcgtgattccgatgctcccccataagctgtccaacggtatctgttccctgaaccagggagaggaccggcttgcgctcagctgtctgatggatatcgatgagaagggaactgtaaccggacatgagattgtcgagacagtaatccgtgtagacaggcggatgacatatacggcggtcaatgcagtgattacggagcatgatccggaagcgatgaaggaatatgagggctttaccggtatgtttgagctgatgaaggaactggccgatattctgaggaagaaacgccacagccgcggttccattgatttcgattttccggagagtaagatcgtactggatgagaagggccggcctgtcgaaatcaaaccctatgacagaaatgcggctacccgcctgattgaggattttatgctgctcgcgaacgagacggtggcagaggattacttctggcaggaaattccgttcctttacaggacacatgacaatcctgatgaggaaaagatgaagaagctggggacattcatcaataattttggttatacaatccgcatgcccggtggggaggtgcatccgaaggagctgcaaaagcttcttgataaggtggaaggcacgccggaggaggctcttatcagccgcctgaccctgcgctccatgaagcaggcaaaatatactacccagaattcggggcattttggcctggcgacaaaatattatactcatttcacttcccctatcagacggtacccggatcttcagatacaccgcattatcaaggaatgcctgaacggaaagatggatggaaaacgagtgtctcattacgaaaagattcttcccgaggtatcggttaaaacgtcggcccttgagcggagagcggacgaggcggagcgggagactgataagatgaagaaagtccagtatatggaacagttcatcggagaagagtttgaaggcgtcatctccggcgtgacaaactggggtttctatgtggagctgccgaatacagtggaggggctggtgcatatccatgagttgcgtgacgattactatcttttcgatgaactccattacgaactgatcggtgagatgacaagaaggacttataaattaggtcagccaattcgggtgcaggtaacaggctgcgaccgttttgcaaagaccatcgactttattccggccggcaatataaacacggcaagatagcggaataaaacaggaggataagaaacaaaatgggaaaagagagcgtaaaattaattgccaataataagaaagcataccacgattactttattgatgaaaaatacgaggcgggaattgagctgtttggtacggaggtaaagtcgctccgtatgggtaaatgcagtatcaaggaatcttttattaagattgagaacaaccaggtctatgtttacggtatgcatatcagtccttatgaaaaaggcaacattttcaataaagatccgctgcgcagcaggaaactgctgctgcacaagctggaaatcaggaagctgcaggccaaaataaaggaaaagggctataccctggtcccgcttcaggtctatttcaaaggcagtctggtaaaggtggagattggactggcaagaggtaaaaagctctacgataagagggatgatatagcaaaaaaagatgcaaagcgcgagattgagcgcgagtttaaggcaagaaacagctagaaaccgttggacagcagcagaaatttaatatgacagctcattggcaggcggcgggtaaccggctccaaaaaaggatgtgagttgtgggctgtcattaaaaggcagagaatagatgtattacaggcaggaaatagcaaaaaattgcgggccggccccattgacagacgatacggttagtgatatgataatggggcataaaacccgttaaacggggcagtaccggtttcgacagggatcatgcagctggtgaagctatccgcatgcgatgcgttaaatggcaaacttaaaattaaacgctaacaataataaattagcttacgcagcctaattcggctgttgtcagccttagagcactcacactttaagaatctggcatcgactatgtgagaaacgatagtgggagggttccggaccgctagtcgtatcagggactactgaagttctgaggatgttcgtttccgcaggatagagggaatgtcaaagaacggactatgatagtagaagaacagggaattggtttttggacacgggttcaactcccgtctgctccatcacaattgttaggacaaaatagatgcagatttgcatttgttttgtcctgacttttttgttatactgaaaccaagattatttatataataggggggataaatgaaatatcattctatgatacctgagttaacaatatcggacattgaaataaccaaagatttttatcttaacaaactaggatttacccttgaatatgagcgagaagaggataaatttatttttttatcgtataatggaagtcaatttatgtttgagcagatacacgaagaaggttggaatataggtaaattagaatatccatttggtcgaggcattaatttttcaattcgcgctcccaatattcgcaaacaatatcaagcagtaatcgattgtaatataaaactgttcagggaacttcaagaagcaacttataaatgtggtactgaagaaatcttagaagtacaatttttaatacaagaccctgatgggtatctgttgcgctttacaaattagctgtgtccgccgaatgagcataatccccactgcatctattttatactaatgacacaaaacggggctgtaaaaaaacagcacctaattaggtacttattttacatctcttttttgatggcggtgccctgcgcgcggatcatacaggttatcgtttaacaggagaactttcctgttaaaaaaacagggagttgagaagattgaactcccaactgccctgctttagtcttccgaagtaaaccccctcatgtatacttccacgacgctgtggatcaatccatccccattcagcggttccgattcatattcatggaatgccgtccaaaactgctcgtattcacattgtgacagaaccatttctccggttgcttcggcgcgttccttgtatttataatatagattaaataattgctgctttaaggtttcacgtctggcgttgtttctccgttcttccatatcatccatcttgtgttcgatttcctggagcatttggctcagcacattaaatttatctcgggtaaccttgttatccgtcttgcccgactctttgatatccctgatatcattcataatggaggtcagcttttcttcgtgctttaacagcatggagcgtcttctctagatcactctgtgctaaatcatgtcttgctttttctatattgtataaattctctaattcttgccgctgattctgtagattttccagttcctgtttatcggtaaatgacaaagtacctaaattttgaatatcttttatcttctggtctacttcgtctaacttggaagtgtaactatccatttttgattgagaattcgcaatctcagaattaagttctgcagctttttcgcttagctcctcgaacgaagtagtacaaacatttattattttatatgctccggccatagcggcgatagctacagtgatgcctggcaagattggatgagctgatgatagtgcttttaattctactccaagaccttttatagacgccttaaatccagcagtaactccagtggcagtggcttcggctgtagttaatccagctgttgtaattatctgctgtgcttcggcagcttcgactgctttcgctgtcataatggcccttgcctgttccgctgtgaatactttttggtttattgcagctattaggacttcttttgaatatccagcagtcgcttgttttaaaccttctacagtatttgctgcctttgcgtttccaagtccgccaatattctccataaaagtaaatgcttttgtaatatcatggattgcatttaatgaattgcctagattcgttagtcgctttatggtatactaaatacaatacttttattaaggttggtgacttttatgaattatgaggaagctaaatattattttgaaaacaccatagatggtataaagtctacaatactattcggtgtaattgctgatgataatatacaaaatggcatttcttatattaaagaacttacatcctgtgatgaccagacagcaaaattaatttggtgcgatttaaagatggattatggaacgaaagcaaacaatccaatccttctagcgagagaagaacaagctaaacaaaaagcgagagaagattatttgtatcgtaataacgcagaatgcccatactgtcattctaagaatacaatgaaaatttctggattatctaaggccggttctgtagctatgttcggtatatttgctatggaaaaagtgggtaacaatggcactgcaataattgcaaatcggatttttagacaaaaaggcaagagtgacctatgggttattctttttgtatttaaatatcttgagattgcttggacgctttaagcatgtaagattttgagtgatattatactttgaaaacaatcaaaggagatataaaaaatggaagtttcctataattttaaatgtaataaatcgtggcggtattgatgtaatgttgattaaatgtccggaatgtgggaaagaaatcagtaacaaatcagagcaatgtattcattgtggttttcctatcagaaagtcgcaagcaaaaaatatttgtaaaataggtaatgtagaatatgctctaacgtcaattcttaatcgtgttttagctaatgaaagtatatatgcaatcaaggaattgagggaaatgacgaatcttggattaaaagaagccaaagatttatgtgataccataaaagcctcaaagaaagtaccgtatgaatataaatatgaggatacggcaaagagcgtatttcatacgtccagtcttccttattgtccgacctgtggttcaacaaatattgaaaaaataggggtattagaatgcggagcatctgtagctatcctaggactattctcaaagaagataaataaatcatttaaatgtcaaaattgtggattacaaaaaggagagagtgacctacgggttactctttttgctatagttgctttgtttccccaatggagcaattttgtgtgaggtagtgtaaaatagtttgtgtctttggaaaaaaatggctcctttcgggcaagaattcagatatggaaattcttactcgaaaggagtctttttatggcagtagcaaaggagcaaattcgacagattatttcagaaaacaacatctccagcgtggcagatgtctactccctcctccgcgatagtttcaaagatattcttcaggaactcctcgaagcagagatggatgcctcccttggttacagcaaaaaccacaaggctgggctggacacagacaacaaacgcaatgggtattctcagaaaactatcaaaagccagtttggagagttcccgcttgatatccccagggaccgcaacggggagtttgagccaaagcttgttcccaaacaccagagggatgtttccggcatcgaagaaaaagtaatcgccctttacgcacggggcatgagcacaagggatatccatgaccagatccaggacctgtatggaattgaaatgtcggccgagatggtcagcaagatcacggaccgcatcctcccggaggtaaaagaatggcagtcacggcccctgaattccctgtacccgtttgtgttcatggatgcgatccactataaggtgcgcgatgagggacgcattgtcagcaaagccgcgtatatcgtcctcggggttacaacagagggctataaagacatcctaagcatcacagtaggtgcaaacgaatcctccaagttctggctgggaatgctgaatgacctgaagaaccggggcgtacaggatgtcctgtttttctgtgtggacggcctgccgggcttccgggatgccatccagactgtgttcccgcaggcgcagatccagcggtgcatcatccatatgctgcgcaattcctttaaatatgtcaattatagcgacttgaagaaattcgcctccgattttaaagcggtctacaatgcctcaacagaagaaatgggaaagttggaactggaaacattgaaaggaacctggggaaagaaatacccctatgccatacgcagctgggaggacaattgggaagatttaagttcgttctatcagttttctggcgaactgagaaagattatgtataccacaaacatcattgagggggtaaaccgccagtaccggaaagcaacaaagaacaaaagtgtattcccgaatgatgcctcactggcaaaaatgctgtacctggcaagccagaacgtaatgaaaaagtggacgcagcggtaccgtggctgggatcaggtgattggccagctcatcctgctgtacggggaacgcctaacgcagtatctgtaaaagaaaaagccggaacggcccaaatctccaaagacgaaaaccgttccgagcttattccgtcggcatttatagtattgccagaaaatcccagcttattccagaggccgggtgtgggcagagcccacgaacttaaaatactataaatgcctgattgatgtgcctaaaaatgtatagaaccagactttctggcaatactaaaagtaaggagatggaacatccggaaaaagtgacaaaaagttccaaaaattgctacatatctaattccaactgaatggaacttccaattttaaagacacaaaaaaatttacgccctcttgtgtgatttagttgtttagttattcacgacagggtgaagtgtcgctgcgttgggacattcattaagagcatatcaactaaggtatgacatactccaaggaagggtgccctctctactcctctcaatccaaatatttttaccccgtcatggctttcgccattgctgctctaacggattatataatagccatttaaaatgtgattgagatggctcgtgcgttaccacggaattcttacatttcagcaagaacttttgtttcatccgattcactgatgatagcagaatagtggtttcaacgaattattcctttatttattttgtttatagaaccctattcgcacagaattgtctgtcacaccatttccatgacatccttttctatactagaccaaccaaaaaatctaggcaatttttgcagctctgcatttgagccaatctaggttctgtataaatgcaccgattccaagtccggctccgacagttccaaacagtccaagtttcccagtcagaaaatccactgcctcagcgaatttattcaatatatcaatagatgccttcatatcatcgccgccaaacaggttctggccgattccaactcctgtttcttttaagcggtttaacttataatcaacactatcgaaaattccattcattgcttccattgcattcccggaacttcttgtcatggaaaccattgcgttttcagcggaatcaaagtttgataagatagtattccccgcgtctgtctgttctttcccgaatagggcctccagagtttcggcctgcgccttgccggcaagagtattccatacgtctgatatttgctttaagatatcgtaggtggatttatatgtattggcgtcctgcatgacggaaacgcctgttaaatcatagattgtctctttgagattatctaaggattcactgaactgtcccgtatcctcgtcaattccgcggatgcgcatggaaacggatttcagtgcattcccggcttcaccggcgtttccggtgatttccgcggcagctgtgccgagggcgatggtctgctccaaggtgttatttccggctgccatggcagaagctgaatttgtcaggatatctacgatagttccattattcaatgcctttgtattcccgctcacattaatcttcgatattatcgtagatgtaaataaatggaaataaaaaacttgcccttaaacggcatcaggcatcatgccgaaaaaagacaaggagggagagtatcaaaaagagaaaatgactatatgaacgatgtaaatgaaaaaatgcaagggtatggtatagatgaatacagataagattttagacgggtactataaagataatgctcagaagctgcgtgcgatagtagacaaactgctgagagattttggcggcatatcccaaaaagattatgatgatttttacagtctggccaatgcggtatttgccggggcgttaaagcagtatgacgccgcccgggatttcgatggatttctttactcctgtctgtcgaacaggattaaaacagagataacacgaaggaaccgtatcaaacggcgggctgacatgactgccatatcaatagatactcccatcggcggggagagcggtgcgacaatcggcgatacgcttcagtctgagtttgacataacaaaagagattgacagagaaaccggcttattccgggacgataaagtggtaagataccttgacagaataccggtccggacaaggcagattcttgagatgaaaatggagtccatatcggcatcggatatcaaaaagatattaaagctgtcggacaaagattatgagaggtcttaccggcaggcccggttttttgattatacgagtattctgtttcaggataccggcagggttagtaatttggaggaggttacagttatgcagaaatcgacacagacgttggagaaaagcaagccggacaagctttgcatagcatcgattaataaaaaaatagaacggcataccatccggtttgatcatccgttacagcgcgaatcggagcaatggagcccggccatgaagggaaatctgatatcagatattttacaggggaatccaatccctccactggtgtttgcggaacaggtggcgaacggactggccatcatctgggatttggacggcaagcaaagatgtacgacagcctactccttttcgaaggatgcttttaaaataactaagaatatcagacgatggctgatcgcataccagacatcggtaaaaggaaaggacgggaccgagatttttgataaatccggttttcctgtatatgaaaagcaggaatttgatatcagaggaaaaaaatattcggagcttccggaagaattgcaggacagattcaaggaatacaattttgagatcgtacagtatctgaattgttcaagtgaagatattgcctaccatattgcaagatataatgagggcaaaccgatgaccgtatcgcagaaagggcttaccaggctgggagagaagtttgcaacgatggtcaagagtatttccggtatgccttttttcagggattacggcggttataaggtgtctgaggggggcaacggaaccgttaacagggtggttgtggagagcgtaatggcggccaattttctggaacattggaagaagaagcaggaggatatgtgtgaattcattaaagataatgcaacagcggaggattttgacagcttcgaggatttggtggagaggattacaagggctggaacggaagaaacatttaacatgtttgattcaaaagattcctttatgtggttcggcctgtttgccagattcgtaaagacgggatttgacgacagcagattcatagaatttatggctgaattttcccgttccctgcaccgcagggagattaacggaaagagctttgatgatttaaatgggaaagcgacaaaggataaagcggtggttctaaacaagattaatcatttagagaagctcatgaatgaatatttgggcaccggaaaggaagcggggccggttgatggagaaaagagcatattagagtttttacgagatacggtaagtccaggtataacacaggaagatttcagcttgtatcaggaaattttggaggatttatcgcttaatgtggatcattcttcgaaactgcttgaagaggcaaaccggccgtctttactggcgctggtcgcttattctattgaaatggatatggatctcgacatatggattgtagagtttttcaaaaagaatgccgcgtactgttcaaaccaggcagagaattataaaaacatggtgaaggagctgacggcgtatttccggaagctccattaaatactgatagcttgagatgggaaaaacccgtatctgcgaaggaggaacagatggataaaagatcattggaatttatccgggaaattttaaaaatggaatgcccggagagaaggtttgttgagcctgggagtattgggaatatgaccgcatctatacggtcggcaactttatatacgggacagagcggggagaggagtttgccggcgcagagcacccgggcttcaagacgaaatattccgtcatgctgcctgtgaactggtaaaaaaagaatgagacacaggtatgatggaaataggtcgggaggtaaaaccggtggaatttattaatacggatgtatggggaattgaacatgccctccgctggtgccacaatctgcaaaacacctgggcaagaagcgacagcggattatgcaaaggcggtgacgatggaatcggctgtgtgcattgtgcaatccggcagcggtgttcccatttttataaccgtgagtttgtgcttggtataagagacatggaattaatgcagggacttatttgggcaggtggtgaaaaggcagagttcctgcggatgatacatgtggcggtggatttagtgacggacatgggagaggaggcggaatggaagaaagacgctgccggaaaaatgggagatggtgccgtatgtgtaacgtgggatacgaattacgcaaaactgcgggaactttacaaacagattagaaagcatgtggacaggaatgttcaggcggtctccttcaaaaaatggattaaatcgcttccatacggcagggagctgatagaatacgaaggagaggagcgccggaatggggagacgatgaatgggtaagcggtgaacaggcaaacgatgtttgccatgtaccgccccctctctccgccaatgagaagaggacaagtaatgagaaaaaggacaaaaccaaaacggttttgtcctctctgaatggtggtatgattcacggcagctacagctcctgaatcattgctctgttttccgtacttttcccccaggcttccagggcaagttcgtatgtatcctggactttctgttccagaactttgatatcctttttcagggacagttgaccggctttcagagctgctgtgtcactttccagcttgtcgagccgctgttcaacacggtcgagccgctgttcaacacggtcgagtcgctgttcaacacggtcgagccgttgttcaacgctgtcaagccgtccctcaaccttaccgagacgttctgatatctcagtaaaaccggcttccatccgcgcttcaatgggcgcaaacagaccggcaatggcctgtaaatcgtctttggtcaaagacatacggtactcctttccgtgtctctccaactattcgaagtctccgcttctttacttgttttagtctagcacattatgagagtgatgtccagcatcagactttaaaattcaggcagccatttttcgcagaaaaatgagcggattgcgaatgtttttgaggattgtgagagtacgcagtgcggagcaatccggtatcaaagggggcaaaagaccttttgaccccaacatcatgacattggttcacacctcgttagaaagcggcgtggtgcgaacaataacacgcttcacaatgaacagaaaatacaaaacagacagaaaaaagtaagaatccatcgaggaatttctggtaaaatataactgtgctggaaataatccaatgtatctgcaatatctggaagaattgcggatgcagttaagccagacgaatcaacacagacaggaaggcaggaaagagaatgagcgagagaaacaggtggagttactttaagaatatctgcagacggtcatcacgtcaccggctggcgtcattgctgctggcagcggtttttatgatgacgggaactatgacatcgtcagcaggaccggctggcagcagtcagacaccggtgcagtcgggagaacttagaggagtctggatttcctatctggactggaacaaatggccgaaggattataacggcttcagacaggccgttgatttagcgatggatacctgtgcagccaacgggatgaacgcggtgtttgtccaggtcaggccggacggtgatgcaatgtatccctccaaatattttccgtggtcaaaatttgcatcgggacagcagggcaaggatcctggatacgatcctctggcctatgtcgttcagtctgcccatgcgaggggactgaaggtccatgcctgggtaaacccgttccgtataaccggatatttgaaccgttacagcgatctttgcagtactaacccggctgtcgtctgggcaaatgatggagatcctgccaatgatcggtgggtgctgctccaccagggagagtattattataatccggcagtaccccaggtgcgtcagatggtgatagacggtgtaagagaaattgtagaaggatatgatgtggacggtattcatttcgatgattatttctacccaggggtaaatgatggcgatgcggccctgtggtttgataaaccggagtatcttgtttcgggcagcagtatgagtatcgcggactggcggcgtgacaatgtgaaccagcttgtaaagggaatatacagtaccatcaaatccataaagccgggcgttgtcttcggtatcagcccggaggggtaccttaagaatctccgttcgaatacaagattatttgtcgatattgatacatggatgacgcagccaggctatattgattatattatgccgcagatatactggggctttgaagcaaagacaggaggacagccggctccctatgcatattccaattgcctgagagactggatagagcttaagaaaaagggcaatgtaaccctctatgcgggccttgcactttacaagacgggtactgatacgaaggacggaaacgaagtaccggaatggctcagatacaatgacatcatgagacgtcaggttttggagggaagacagagcggccaggtgagcggatactgtttctatgatttcagctccctgacacgggcaggggctgccgccgaagtggcgaatgtaacggcgttgtttaaataggactgttcacacggttgtgcatcgcggagcgtgttattgtccgtaccacgccgctttccggcgaggcgtgaacagtaacttaaatagacaggacaggcaatttcatgtaaactacaagttgataaaatcaaggcagcgcgctataatggcaaaatatggttattatggcgcattgcttttaaatcaactgtttacaggagccggacgatgaataaggataagaacgatttttcacagggaagtgtggttaaaaatatcatgagtctcgcagtgcctatgactttggcacagctaatcaatgtactttataacattgtagacagaatatacataggaaggattccgcaggattcaaccctatcactgacgggaattggcctttcgctgccgatcattacaatggtgatcgcgtttgccaatcttttcgggatgggcggagcgccgctttgctctattgagaggggcaggggaaggatcgaggaagcagagaaaatcatgggaaattcctttaccatgatggtgatatcaggcgttctcctgaccgctttcggtttgatattcaaacgtcccatgctctatctgttcggagccagcgattccacctggccgtttgccgacgcttatatcacgatttatctgttcggcagcctttttgttatggtgggtcttgggatgaacagctttatcaattcccagggatttggcaaaatcggaatgatgaccgttctgttgggagcggtttccaatatcattctggatccgatttttatttttgtcttggatatgggcgtgaggggagccgccttcgccacgatcatatcccagtttttatcggcgctctggattgtcaggttcctgacgggggagaagacgatactcaaattaaagcgctcctgcctgaaaccggagctgaggaggattaaggcgatagtggggctggggctttccggctttacgatggcaattacaaactgtacggttcaaataatgtgtaatgcaacgcttcaggcatacggcggggatctctatgtgggagttatgacggtcgttaactcagtccgggaagtggcgtcacttccagtttccggcattacgcaaagcgcgcagccggttcttggctttaattacggcgctggggaatacggcagggttaaaaaggccattgttttcacagcggctgcagcgattgcctatacggtcgggatctggagcctgattcacggtttcccggaattctttatccgaatattcaacaaggacctgaatctgatagaggccggtgttcccgcgctgaggctctatttcttcggattttttatgatgtcgctccaattttcagggcaggccatcttcgttgggcttggaaaatcgaaaaatgccatctttttttctatattccgcaaggtgattattgttgttccccttacaattatgctgccggggatgttccatatgggcacgtcgggcgtatttgcggcggaaccgatatccaattttatcggcgggattgcctgttttggtactatgatgcttacggtatggccggagcttacaaaaatgcagagggagaagggaagagagacaggtggaattcagaatcaaaaaagcaaagcttaatgacgttaatgcggtggctgctttgatacgggccgtttgggaacagatggataaccgggaatggtttgtaatggatgaggcggatttcctgaaagatgtgctggaatcaggccgaggctttatttatatggccatagatgccggtacagagaaactggcgggagtcatggatattctgacgccgggccttgaaaaagataatctcggatatgatgccgggttccgtgaagagaagcttctaaggacggctcacgttgattctgtggccattttgcctgagtatagaggaatgcgcctacaggcaatactgatggaggctgccgaacaggagctggctgtgaaaggataccgttatatgatgtgtaccgttcatccggataacagcttcagccgtaacaatatggtaaggcagggataccgtgcggtatgcagaaaagagaaatatggcggccgaatcagggatgtcatgttgaaggagcttcccggaattatataatgtgaacggattttttgattatttaaaaactttcggatactgcgccgccttaggcttgacaaatcaatttcgagtgctataatcaaagcgtaaaataaatagtgtaaaatgcgatgagaagaagagtaagacagggaaactgtccagagagaggcatggaaacaggtgtgattgccttacagcggatttgtctgaagaccggcttcgagtgtcccttaatcgggaacggtgactccgttatagtcatgaaacgataacctgcatgctttacgtacaggttaccgccttcaatgagaggtccggataatatccggtcaatcagggtggaaccgcgagaaattcgtcccttgatacacagattgtgtatcaggggattttttaattgatgacggtgacctgttcgcggaacgtgcaggttatcgtttatcaggaaagttatccagttaaaccgccgccaaagcggcccgccgcaggcggagattgtgctttaacgcaattttgtttattttgagaaaggagaagaaatgatgaaaataacattaaaagacggctctgttaaagagtacgaaaatcagatggcggtgatcgacatcgcaaaagatatcagtgaaggcttggccaggatggcctgcgcgggagagattgacggggagacggtggatctgcgcacgatagtctgccaagactgccggctagacattctgacggcaaaggatgaaaacggactggctgcgctgcgccatacagccagccatgtgatggcacaagccgtaaagcgcctgtacccggataccaaactggcaatcggaccgtcgattgcagacggcttttattacgacgtcgatccggccacgcctttgacggcggaggatttgccgaagattgagactgaaatgaaaaaaatcattaaggaaggccttgccctggaacgcttcactctttcccgggaagaggcaatagcactgatgaaggaaaaagaagagccgtataaggtggaactcatcgaagatcttccggaggatgctgaaatcagcttttaccgtcagggagaattcacggatctttgtgccgggccgcatttgatgaatacaaaaggcgtcggtaaagcatttaagcttatgaatctggcaggagcctactggagaggcagcgagaagaacaagatgctgactcgaatctacgcaacagcttttgccggcaaagaagaactggaaagctacctgagaatgatggaggaggcaagaaagcgggatcacagaaagcttggaagggaactgggccttttcatgatgcatgatgccggccccggttttccgttcttccttccaaaaggaatggagcttaagaatacactgttggaatattggaggcaaattcataaaaaagcaggttatgtggagatctccacaccggttattttaaataggaagctttgggagacgtcaggtcactgggatcattataaagataatatgtatacgacagtgattgatgaggaggactatgcaattaaaccgatgaactgtccgggcggagttctcgcctatgcgtcggaacctcgttcctaccgcgatctgccgcttcgaatgggagagctgggtctggttcaccgtcatgagaaatcgggccagcttcacgggctgatgcgcgtgcgctgcttcacacaggatgatgcccatatctttatgacgccggatcagattaaggacgagataaaaggcgtggcccacttaatcaacgaagtgtattccctgttcggctttaaatatcatgtggagctttccacgaggccggaggacagcatgggaagcgatgaggactgggagatggcgacggaaggcctgcgtttagcgcttgatgaactcggccttgactatgtggtaaatgagggtgatggtgcattctacggtccgaaaattgatttccatctggaagattcaattggaaggacatggcagtgcggcacaattcagcttgatttccagctgccgcagcggtttgaactggaatatacgggtgccgacggcgaaaagcaccggccgattatgattcaccgcgtggcctttggttcaatagagcggtttattggcatcctgatcgagcattttgccggagcattccccacatggctggctccggtccaggtaaaagtgcttcctatctctgataaatacgcagattatgctaaaacagttctggaggagctggaagaagccggaatccgggcggagcttgatacgcgttccgaaaagatcggttataaaatccgtgaggcccagacacagaaaattccgtatatgctggtagtagggcagaaggaagaggaggaaggtaatgtctctgtgagaagccgttttgccggggatgagggaagcgattccacagctggttttattgagaaaattaaaaaggaaatagcaggaaaagagatctggcaaaccgaggcaaaagaggaaaagtagagacagcaggaaacgaataatctctatttatattacgcatactactcctgtatcaggaagactgagaatatcagtttttgtaaaagataaaatcaagaaacaggaggaatcaaccatgacgaaattggattgtaatgtaacagggtgccttcataactcagaaaactgctgctgtaaaaatgtgattgtcgtagagggacagactgccagagaaaagtgtgacacatgctgcggcagctatgatgaaaacaagggcggcatgttccgcaatatgttcaaaacccctgagaacagattggaagtagagtgtgaggctgtgaactgcgtatataataaggatcgtttctgcgaggccgaacatatcggcattacgggcggagacacaaccgaagcgcagggaacggaatgttccagcttcaaagcccgctgagcggaataaacaataaaaattgcaacaataaaaattgaataaagggattgacaatccgggaatagtatagtatagttactgatgttgtacttaaaacaacacgacaggaaagcaggtatccgcctcaccctggcacgagcaagtgaccaagggttcatatttagctgaaaattccttaattggatttcctattatgataagtggatagtctgtctatccacttattttttgcagtctataaatattatcatgtgatgggggtgcacgactattagcgatttaatgattaacgaacagattagagacagagaggttcgtttggttggcgagaacggagagcagcttggaatcatgcctgctaaagatgcgttaaagcttgcaaaggatgcagagcttgatttggttaaaattgctccaacagcaaaaccgccggtctgcaagattatcgattacggtaaatacagatacgagctggccaggaaagaaaaagaagccaaaaagaaacagaaagtgatcgaagtgaaagaagtgcgtctgtcaccgaatatcgatgacaacgatttaaatactaagattaacgctgcgagaaaatttatcgaaaaaggcaacaaggtgaaggttactcttcgcttcagaggccgtgagatggctcatatgtttaagtcaaagtatatccttgacgattttgcagaaaaactcgctgatatcgcaacggttgataagcctgcaaaagttgaaggaagaagcattgtattgtttttaactgcaaagcgttaaaatagacaaatatctaaggaggaattttaccatgcctaaaatgaaaacaagcagagctgctgctaaacgttttaaaacaacaggaactggaaagttagtaagaagtaaagcttacaaatcccacatcttaactaagaaatctacaaagagaaaaagaaatcttagaaaagacatcgttaccgatgcaacaaacagcaaggtaatgaagaagattttaccatacttataagattcgaggattaagaaggaggaattaactcatggcaagagtaaaaggcggattaaacgctaaaaagagacataatagagtattaaaactggcaaaaggttacagaggtgcccgttctaaacagtatagagtagctaaacagtctgtaatgagagcattaaccagctcctatgcaggacgtaaagagagaaagagacagttcagacagctctggattgcacgtatcaatgctgcagcacgtatcaacggtttatcctacagcaagttcatgtacggcttaaagctggcaggtgttgagatgaaccgtaaggtattatccgacatggcaatcagcgatgcggaaggatttgcaaaactggcagaactggctaaagcaaaattaagctgattttaataaccgagaaaaataagtgaccggaacattttgtcgatagataaggtgtttcggttttttttgttgtgaaaaagtaaaagcactttaatagcaacctggtttgtgatataattccgctaagcgggtattgtttctcaaatctgctgaggaggggaaaatataatgaaaataaagataacagccgccgctctggctgcctgcctgttcatggccggctgctcaggagcggcatcagtgaatacgtcaaagaacagcgagccggtagatatcacgatctggcattactataatggttctcagaaagcggcctttgatgacttggtaaatgagtttaatgacacggtaggaaaagaaaaaggtatctatgttgagggacatagcaaaggaaatgtctcagagctggaaaatgccgtcctttcatcgagcaggaaagaggtgggaagcgaggagatgccggatattttttcttcctatgctgacacggccttcgaattggagaaagagggccttttagcagatctggccccctattttacggaagaggagcagaacagctacatggattcctacatagaggaaggaaaaatcggactgaacggtgagcttgagatattcccggttgctaagtcaacggaaatcatgatgatgaataagaccgtatgggacgagttttcggccgccgcaggcgtgagccttgaggatttaaagacgaaagaaggagtggtccgggtagcggaacgctattataactggacagacggcaagacaccggatatcccatacgatggaaaagcgttctatggaagagatgctgtggccaatctttttattatcggctccatgcagcttggcgtagagctgtttcatgtcgaaaaccagcaggtaacgctgcagattgataaagatgtcttcaaaaggatttgggactgttattatgtcccatatgtgaaaggatattttggggcctatggaaaattccgctccgatgatgtcaaaatcggagaactgattgcctataccggttccactacctcggccggttattttcccgatcaggtagaacagggcgataccataaccccgatagaatgcattgtgcttccggttccttcctttgaaggcggagctccttatatcgttcagcagggagccggaatggtggttacaaatggcccggacgataaggtgcgtgcggcctgtgaatttcttaaatggtttaccgattctgaaataaatacggaattcagctgctcgtccggttatcttcctgttaagaaggaggccaatgcgatagacgtccttgaaaaggtgatggaagaaaatcaggttgacatgccgcaaaaggaatatgatacgctgacagaggcttataaactggttaagaataaccagctgtataccaataaggcttttgacggcggaagtgacgcaagaaaggttttggaatacaatttatcggacaaggccgctgcagacaggcagcaggtggaggcgcttctggcagagggcagcagcctggaggaagcggtggaagactatatttcacaggaatcatttgactcctggtttgcttcgataaaggaagagcttgagtcctgtgtggaagtcagcggggcagggaagacgcagtaagccggaatgcaggcaaggagttaaagatgcgcaaaaagaagacaattctcaggatgtttttgataccgctttcagtggtaatgcttcttcaggcggcagtggccttcggggccgtacacatcggagggacggtaaagcatttagatgaatattctgtggggattatggagcagattgtaaaaaacagaaatctgatcctttcaaataacatgacgcaccagtggacggatatatccggcgaatatggaatagcgaactcctgctttgaagagattttagaggaaagaaatctgacgctccgtgagtttatggaagacgaagaggcaaaaaatgagctgttaaaacaactgctgctcccagggctggatattttaagaagaaacggagtgaacggggtttatttcgtgctggcagacggcctgaaggaaccgcagaaagagaagggaaatgaggtctataaatgtagcggtatctactttcgtgattcggacccttacgtaaatccaaaggattattccgatctccttatggagcggggaaattatgagttttcacatgagcttgggattccctttgacacctcttggacttcccggtttaattttcagcgggacgggctgctggaagccgataatttcttctataagccttataacgccgcggtggccaatccaaaagccaaggaagagaatctggcttattggggcagtaccttttatctggaaaataataagcaaaaggattcatacagcatgattagctattcgataccgttgatcagtgagggcagggtatatggtgtcatggggattgaaatatccacatcggtcataagcggccttcttcctgtccaggaactgaatgcaggggaccacagcggatatttgatggcgcaattcgacgatgacggcaatttgattccgttctttctcagcggtctgatactcaagagaaacatgacggcatctcagcctctgaaattgcaggaaacagaatatgcaggactgtatcagatagatatgcaggagaagggggcagattattacgcccaggtgataccgttttccatatataatcccaataccccgtttataaataatggctgggttttgatgggagttcagtcgggcgacggcctatttggtatgggcagcagggtcacgcgcaatattgccctggcggtgctgatttctctggcggtcggtattacttctatctgcctgctgatgcattacctgacacgtcctattacgcagcttgcggcttggatccgcgataacaaggaggacggtccgggggactatgggaaaacagaaattgccgaaatccgggcattatacgatgctgtttcagacttgacggaaaaacagaagacagcggaggcgaaggcggaggaagaaaaagagcggtacctgctggcgctgcagagcagcacggatattatttatacgtataatgtggaagataactcggtagatatttataatctgcttgccgatggaaaaaagagcggccttggcacccatatcagcaatctgacggaaagcattcagcagagtaagatactctatgacggagatcgccagatgatgaagaaaatgttcctgaggctggatgagaaatttgagctggatttcagggccttaacagagaagaatggctggcagtggatggaaatctccggaaagacgatttgtgatgtttccggcaggaaaagcaaagtaataggaagcatacggaacatacaggaacaaaaagaaaaggagcagatggagagtaaagcggcccgcgttgatccggtgacaggcctgtacagggaaaaagtagggcaggagattatcaaagcggaggcgcagctcggacggaccggttttatgcttcttatggatcttgataagtttcaggagatgaacgatggctacggtatagaatttggtgattcaatcctggaagagataggcattttcatactgaaattaaagtcagagcttgagaagtcaggaaagcgtataattgccgtgagggcagggggcgatgaaatcctgatgtggctgcgcggttttgaaaaacaggagatactgggcatatttaacagattgaaccatatgctgtcacgcctgtgcgatcggggtgagttagatatctcggtaacagcggcggccgcgttcctggacgggaagcaggaggactacgcgaggatgatagagaggctgcgtaccgctctcggctatggaaaaagacgcagaaagtcccagttaaccttctgcgaggatgtgcctgagtctgaatgtatcgaaaaacgggattataatgagattgcaagtaatggaaatgtccgcgctctgaatatggtaaccagagtgtttaatctttttgacagaggcgggcaggtgggaccgattatttcggttttgtttgcaaagcttgggggtacatacagggtttcggatattctgatggcagacatcaggtgggatttcaatgcttccggaatatataagcaatggcatcagcaggaggacgctgaagaggacacggcggtttaccattttaaggccggagctatggaacggtgttccgggcattttgtctccggatatgtgaaattcgaagaaaataccgtatttacaacggaggaacgccgtattcttcatattccgcttaaggcgccgggcctttgtattccaatgtatgacggcggcaagctgatgggagcagtcagctttatccgcaaggcggaacacagtgactggagcgtggaagaatgctcggagctccaggaagttgtgaagattatcgagacaaatattaacagggagagatatgatctggccagccgtgccaagatcgatttcctgtccaggatgtcccatgagatcaggactccgatgaatgcaattatcggtatgacggccattgcaatggatcgcgcaaagcaggaggaaggagtgaaggaatgtcttattaagattgaccagtcctcccagtatctgctcagcctgattaacgatatactggatatgtccaagattgagagcggcaagatgaaactggcctgcaataacggcagcatcatgaaaatggctgaagagatagacgatctgatggaaagccagatgcggcagaagaacatcacctgcatccgcgatatacaggtggagaatccgtgggtttatgccgatttgatgcgtttgaagcaggtaataatcaatctgttcagcaatgcggttaagtttacaaatgaaggaggacagattcggttctccgtatatgaacaaaagatggaaagacgtcagccggaggatagaaatgaagcggaatttttctttgctgtagaagataatgggattggcatcagtccgcagaaccgggaacggattttcaacgcatttgaacaggcggaggatgatacggctgctgcatacggcggcaccggtctggggctgtctatcagcagccggcttgtccggatgatgggcggtgagattgggcttgagagccgggaaggagaggggagccgattcagcttcacgctccgctttatccgggcggaagagccggggacaagtgtacttccgggacagaatacgggggaatatgattttaccggcaggcggattcttctggtggaggataatgtactcaatacggagattgccaaaacactccttgaaatgcatggctttattgtcgatacggcagggaacggtaaggagggcgtagataaatttgccgaggcttcggaaggaacttactgcgtgattctgatggatatcaggatgccggtcatggacggtctggaggcggcgaagacaatccgccggatggcccgaagggatgcgcagagtgttccgattatcgcaatgacggccaatgcatttgacgaagatacgaagaaatccatcgagagcggcatgaacggccatctggccaagccggtggatatccaagagctgctgagggcgatacaggaagtgctttaaattcggcccgctttttagcgggccggtaacgggttatcacataacgtctgatgttcaataattttgtagattctgtgcaagggaaggcaaaaaaacgcaatagttaaaaaaattaaaaaaatttgaaaaaagtggttgccaggttccaaactttgtggtatactaattttcgttggtgaggcaaacaaaatcaccgaatgcgggagtgctggaattggcagacaggcaagactaaggatcttgtgggtgtatgctcgtgtgggttcaagtcccatctcccgcatgatgcagaagtggcggaattggcagacgcgcacggttcaggtccgtgtggtagcaataccgtgagggttcaagtcccttcttctgcacgataacagaaggcagcttttcgataagaaaggctgcctttttttctgtctaaataaaaataatccttttaatccgctctatgaagcggaaaaacaaaaaatatttcaggttagtaaaagtaaatcttccggtaaaacccgcagccaggacggtacaggcggctgggaagatgagccggaatcctttttgacggtccagcagagattgttctcaaggcagaattcccagtcgaaggggagaggagacaccaaaggagcgtttaccggtatcagattggcgccgggccgttccttccagactgccgcagcttcctcacttacaggaaccaggcagtgcggccgtatggcgacggcctttgtctgctccgtggttttttctgcggttgtcagcgtcaggttccagtcgagtgccagaatccggttatctccaagtctgcgcacaggagatatatttctgcagccggtcagccgcgccgcctggtatttgcccggattatcaaagacatctttcgtagctccgctgcagaggacctgtccctgatccatgatgatcaggctgtcgcagagctggtatgcctcatccttatcatgcgtaaccagtatggaaagaccgtgataatcgcgcagcacatgaagcagctcaagacgcagcacctctttcagagcggcatccatggccgaaaaaggttcatccagcagcagaagagcaggggaactggccagtatgcgggccagtgcggccctttgctgctgtcctcccgacaatttgccgggataataattttccaggccggacagccggaaccggtgaatgcaggcagagattattttgtcccgttccctgtttttgagactgattccggagccgacgttttccgccaccgtcatattgggaaacagggcatagctttgaaacagatagcctgttttacgaagctgcggcttgcggttgatccgttccgcggacgaatagaaggttttgtccccgaggaggatccgcccgcagtcgggcgtaacaagaccggcaatggattttaaccccatgctttttccgcagccggaggggccgaggatacccaggcagcctcctgtatgctctagcttcagttccagcgtataatcgtgcagttttttctttatgtcaacagtcagcgtcatgtaattttctcctgtgtttaatttctccattttgtattcccggcccggctcatcagcaaaagtgaggcaaatgcaaataccatcagaatcccggcataaacgagtgcggtatccatacggccggatgctgtttcggagtagacggccagagggagggttctggtacgtcctgcgatattacctgccagcatagctgtggctccaaattcgccgagtcctctggtgaaagccaggacactgccggagagcagcccgggaatggagttcggcagcaggatgcgcagaaagatttttgtctcccccatgccaagagttctggccgcatccagcagatgcggatcgacctgttcaaaagcgccgcgggcagagcggtacatcatggggaaggagacaaaggccgaggcaatcaccgtggaggcaaaggaaaaggcaattttcacgccgaatacatcgagaaaaaatcgccccagcggacggttcacgccaaagagacagagcaataaaaggcctgccactgtagggggcagaactaacggtaatgtcagaagactgtccattacgattttcagccgctgtctttgaatattcataacctgccaggcgagcagggttccggcgggaaagacaatgagcagcgcgcagactgccgttttcagcgaaataattacaggtgagaaatccatacagcctcctattgaaaacgtttacggagtgatacttatgttcggttattccggcagcggggagaaaccataggaagaaaaggcatcctttgcttcactgcttttcagatatgccagaaaaagttctgcaccgtcccggctgccggagccggagagaattgcggcggggtacaggacacgctccgataagcttccttccggagccggggcgattacttttacccgctgtgtggttgcagcatcggtggcataaacgattcccgcgtcggcacttccttcggctacccagttaagaacttccgtgacatttgtgccaagactcagtttggtgttcagggaatcccaaagtcctgtctgggtaagcgcttctttcgcatactgtccggccggaacgctgtccggatctccgatggcaatgacagcagctttttcaatatcggtaaaggagccgtagctgtcctcagaaccctccggtacgatcaatacaatttgattttccaggagcatagtgacggaagccgaatccaacagccccttctcgttcagagcatccatctgtttcgtggcggcggacaggaacagatcggcctcaagaccctcctcaatctgtttctggagctttccggagctgtcataggttccggttacggtaaagacagggtgtgatttggtaaagccgggaatcaggacttcttccataaccggcttcaggctggcggcagcagcgatgaaaatttccccgccctgttcatctccgcccggtaccgggctgtcagccgtttttgcctgtcctgtgctgcatgcggtcagggccagcaatgagagcattgccgcggaaaggacggccctcctgattcctttacagattctgagttctgttgataaattcttttctcctatcttgcgcattctgttgcacctcctcttaaaatttcaagcccgtggggcagctcgttcaatataaaaccaatactttcccggaccgccttcggactgccgggcagattgatgatcaatgtttttcctctgattacagcgacgccgcggcttaacatggcacgctttgtcacctgcatggaaaagctgcggatcgcttctgcgattccgggagcattacgctgtgccacagccatggttgattcaggcgttgtgtctcgcggggagaaacctgtgccacccagagtcagaatcagactggcctggcggctgtcgctaagacgtatcagatgatgcttcagctctttgggctcgtccggaatcagaaaagcctcgatgacccggtatccggcatccgacagcagagatactgcagctgggccgctttcgtcaacccgcagaccgtccgcacccttatcgctcagggtgatgaccgctgcggtgaagggccgtttcggtgaggggggaaatgcgagaatttcatcaccgggagtcaggcgtccgcttttgagtacccgtgcgaatacgccccggaccggcataatgcattcgccgactctgtgatagatagagcaatggcggtggcattccttgccaagctgcgtgatttccaggataacgtttcctgctttaagggtggaacctacctccaaagcggaaaaatccacaccgtccaccagcaggttttcaccaaaatccccgtccgtgacaccgccgcccttttcattaaattcccggacgcgttcagcaggcaggaggctcacctgacggtgccattttccggcatgggcgtcgttgctgattccgtagtcttccagaaaatccccgcagggcacgggatgcttattggtgcctttcttttcgctgatacagattgcttttataactcccatcaattatcctcctatttttgacatgcttttatgctccgctccgctttgttttccgccaaaacagtgacagggcggtttttggcttaccgtgcgtagaatagctttctgcagggcgtctttatatccggcttgcctgaaaagcggtttgatgcaaatgttgctttcaaatcccagacagcctttcagaaaaccgtcggcggtcagacggatacggttgcagcttttgcaaaagctgccgtgtacggcgctgataaaaccgatgcagccggtaaaacctgggatgcggtagtagacggcaggaccgaatccgcgttcactttcctccggcttaatgtcaggataccgggaggacagaagtttcagtatatccaggtgattcagggcaggcatggggggtgcttccaaacggcatggcctcaataaaacggacatcggctgggaaactgcgggccatctcagcgagagcaagataatcggtgacgggtacaagcccatccatgattacacagttgattttcatggggattcccagcccggcggtactgcggatggaatctaacagttccggaagacggtctgaaccggtgagggccgcgtagcatgccctgtcaggcgtatccatgctgatattaattccgtcaattccggcttccttcagccgtccgagatgttctctgagaaggagaccgtttgtcgtgagagtaaccgtctcgatgccggatgttttttttagcttttccacgatggagcagcagtccgttcttagaagcggttctccgccggtgattttgatatgccggatgccgagaattgcggcctcacggcagaacgcaaggatttcctcagacgtcagcagtgctttcctgctcagaaacggggaattttccggacggcagtaggcacagtttaaattgcagcggtctgtgacggagacgcgcagataatcaataattctaccgtagggatctttcaaacacaccgctttttcctcctgatttgcggagaaggcaaatctctccgattgtcattgtcttgtccacagccttgcacatatcgtaaattgtcaggagagcggcggatacgccggtcagcgcttccatctccacacctgttttgccggtggtccgtacggtgcagaccgctttgatttcgcagtctgcctcatggatggaaaatctgatttccgcataagtcagattcatgagatgacagagaggaatgatgtttgaggtctgtttaagcgccattattccggtaattctggcaacgcccagtacatctcccttttttatccggccggtactgacccgttccagacactcgcgcgtcatagagatccttccgcctgccgatgcttcacgtacggtatcttcttttccgccgacatcaaccatgacagcttctccgttttcgttaaaatgggtgaattccattgctacacccccttgccgaagccgcagtttggaaaggtacagaccggacaggagaggcataatccgccttcgccaagggaagcgagatcctctggcgtaacggggtcctccgccatcaggcggggaaggatgagatcgaagatcgtgcgttctgcatacatgacacagcctggaaggccgacgatggggacggtgcgtcctccgtattcgcagtaggcgagaaggaacatggctccgggcaataccggtgcgccataggagacgatatgcgccccggtgtttttaatggccagcggagtctgatcatcgggatcgacgctcatcccgccggtgcagcagacgagttcggccccgttttcaattaattcaataattgctttcgtgattctttccggctcatcgggcagagtgatatgaccggttacttccgcgttataatctttgagcttctgtataataacaggagtaaaggtatcggcgatgcgtcccctgtacacttcgtttccggtagtgacaatgccggcttttttcagcgtaaaggggaggagggagaaaatgggttctcctccggcggcctcctttgccttatccatggaatccatggggatgacaaggggaatgattctggttcccagcagcttgtcaccggcccttacggcagtgtcaccatggcgggaggcaatcatcatctgtccgagggaattgatggctttcagcttgtcacggcggattttaaataaaccgctgcactcggcagtcagctcgatttttccctctttcactcgggaacgtttcatattgtcatttaagcaaatactgcaaagtatctcggcagcttcgttttcatggagcatggtttcgtcattatcccatatgtacagatgttcttttccaacgcttaacagcaccggaatatcctcctcagcaacaatgtggcctttgcggaatacggcatcctttgttacgcctttaataatctgtgtgatatcgtggcagagtacggagccgacggcatcctctgtctttatcaatctcatctgttttcctcctgtttcttcttctcctgagtaatatttgtctgattcagtccgctgcggactgctatcagctcggcggcaatactgacagcgatttcagcgggagtggaggcaccgatatttaacccgatgggagcgtgaacgcgttccagctcctcggtacggaatcccatatttaacagcttttgagttaaaacggatttctttttgcggctccccataacaccgatatagagagagggggagcgcatggcacaggcctgggcctgaagatcaaatatatgtcctctcgtcatgatgacgaagtaattcccggcggcaggatacaggctttcctccagatggtcaaaggagacaacggcggtgccgaaggcatccgggaagtcctctattcttagaaattcctctctgtcatcataaacggcgcaggaaaatccgaccctcgagagcagaggaaccagctccctcgccacatgtccgccgccgaaaatgtgaaccaggctgtcggacgcaatcggttccagataatattccctgccgtccgatacggtggtgcctggctttccccggcggcaggcgtccgtgacagacgcgggaaccttcggcggaagaggaatatcagggccgaaaatccccataaattcccggccggcgccgcggccgcgagaaacagagcggtccgtgccggcagaatgagcagaggaagcggaagtttccggaagttcgagtaccagccatagatttccgggcgcctttagcaggggcagggcggtacggcagagggattttacatcttcccgctcaggaccgatatagtggaatgccaacttaacccttcctccgcagaccataccgatcccggaggagggctcagacaaatcatattcccggcatgcggaagtctgttttaagagtagacgtgccgcttcgttctgggcttcatattcaatcgggccgccgccgaccgtacctgtgatccgtccgttccggccgaccagcattctggcaccggctcccctgggtgcggatcccaggctgtcggtaacggtgactgccattacgccgttcatattttccagctctttcagaagcgctgtcaggtaaagcgttatttcattcattgcagatcctccccaaaatatttgtcaaagcaggctttcgcataagccgttacttcctcatcatacgcagtaaaacgttccagaaaagcctcaccttcccctgtcagggtggtggccccgccgtcgcttccgccgggccgtctgtgtatggcggtaatgccggcctgaagctccaaatcgttcaggatattccatcctttactgtaggacaggcccatcagtccgcaggcctttttgacggagccggtctgccggattaaccgcagaagcatggctgcggtgcggtcaaagaagggcaattcccgttccagagacagactcaccagcggaagaaagggctgttttctgtggcgttccagaagctcggcacagtcagtggaaagctctgcatcaaacaggacgccttcgtcgggaacttccaccagagtgcgctgatacggagagaggcggagggcttcacgcagaccgccgttcccctcgtatccaagcagaaacggctggatatttgcaccaagtaagagaggatgtcctctttttttgttgatctgaggcacggcagattccgctccgctttccagcagaagcagcacggtggacacggtaaaaagtggtatgtcggccggggtaaacagcacagggcagttcgacgcggccagataggccagaccgatgcgcacggaggccatcatatcggaattttcccagtcctcattacggagacagatggcgccgctgcgggcaagatggcgctccagttctctggcttgatatccggttacaacgacaatatccccggcgccggcctgccggaatgtatgaataattctccgtatgacagacagtgagccgaggggatcggatacctggaaactgtctctccggcgcggcttaccggccgctgcaatcagcgcgtgaaatgtcggaatactcatcgttttacctcctcaaaagttttttgattcgttcataatcctccattgtatcggcatccgtgaggatgccagggtcggagaccgcaagcatcaaaggctttatggatagcccattcagcgccccgcgcagtccgtctgtcccgtcatgctcaagcagcgcaaaaagcatggatgaggagacgcaaacaggatggcctttccgaccgctgcagacaggaataacgatatctgcctcctgccgcgccatgcaggcgatagtctcggaagagacgagcggtatatctgccggacagagaaaaatcttatccgggagcggcgctgcctcctccttttggagagagagaaggcccagacgcagcgagtcaaacatctgtgatgtccgataggcggagttatggaccagacggacgggcagccctcccagatgagaggcaagtgtttcagccatgtagccggtgacgactgtaacgggaagggaaccggctccgacaaacgcgagaaccagggaacgggatatgctttcttccccgagaggaagaatcggtttgaatgcacccatccgggtagataaaccggcagcagcgattacggcggtaaaggtattagtcggacacataaaatttaacctccggatagattttgacagactgtttcgtcagaattggaacgagtatatcattatttgtggcaaattatcaatattttattttaaaattgtgtgatatgacaatataattgaagggaattgggaaattcaggttaaaaagtatacaaaatatacaaatagacaacaaaaatgcttacgagttattttgaaaaagaattattaagactggtttgatgaataaaacaggccgcagaatctgcttgtatttggcgaaaatagccggatatcggtgtaaaattttgaaatttaacggtatattttgaagtttgctgaataatatttacaggattcaacgctttttcaacgcagcgctgctatactatacccaacaggtaaatgaccccattcggggatggcagtataaaaagagtggattccaaagacggaacggaagttgaggtggattatgaagttggtctgtacaataaacggtgaaaaggtagagagggaggctgacccctgtaaacggcttctcgattttctcagggatgactgcggtctgactggagtgaaggaggggtgcagcgagggggaatgcggagcatgcactgtgctgctggatcagaaggcagttaccagttgtaccgttttcaccggtcaggtgatggggaaagagattataacaatcgaagggctggagaaggacggagagctggatgtgcttcagaaagcttttatagagaatggtgcgattcagtgcggtttctgtacgcctggcatgattctgtcgtgcaaggcgcttttgatggagtaccccaatccgtcggatgagcagattaaacgggcgatagagggcaatctctgcagatgcacggggtatgaaaaaatcaggacagccgttagagcggccgtgaaggagggagtcaattgaattttgccatgcctaagacgagagaagagcttgcccgggttctgagagaaaataatggcgcattgctgtgcgcgggcggaacggatttgatgatcaggctgagggagaaaaaacagtttcactattccctaatcgacctgacccacatggctgagatggccggaattaaggagacggaaacctccgttataatcggtgccgccgtgacaatggatgaactggaacgcagctccctgatcaggaggtatctgccggccctatccaaagccgcatcaatggtcggctccacacagatcagaaacagggcgacaatagggggaaatgtgtcaaacgcttcacagagttccgatttaactccggttatcctggcctatgatacacgtgcggcggtctgtgacagtacgggcggtatcagaatgctggcggttgatgagtttgtgaaaggcctcggcaggacggagcttggagagacagatgtaatcctgtggtttgaggttgaaaaaacggctgccttttccggctttgcaaaggttggctcccggaaagcagtagccatttccaaaatcaatgtttgtgtcaaggcggatatagaggatggaatactgaggaatgtttccgtgtttctcggagcggttggccccaaggcaagacgttctccttttattgaactggctctggaagggatggaactttcccgccgggatgaaagagtcctcaaggaagctgtttacgcccagattgaggatgatattccggacagaagctcaaaacattataaaaaacctgcggcatatggaattatctgtgatgcgctggaagaaatcaagtcgcagacggaaggaggggagcgcggtgagtgaactggaatatgtggggaagagatatgtgcgcgaagatgcgtatgacaaagcgcgggggaagaaccggtatacatgtgacagaaaattaaccggaatgctgtttgcaaagctggtactcagtgaaaaggcacatgcgagtgtgcggatccgaaaggaaaaagcgctgagcgtaccgggaatcagggctgtattcacatttgaggacgtaccggcgaaagcctacaatcctcataactggtccgcctgtattgattccccggaagaccagtacatactgagcgataaggcaagatatgtcggagatcatctggcgcttgtcgtaggggaatccaaggcggcggtggaggaggctgtgagcctggtcgaaatcacatacggggaggaggcgccggtaatcggcctttcgtcggccagagagacggaaaatgcgatggcttttgagaaggaagtatcctttggagaatatgataaggccgaacgagaggcagccgtcattgtgacgacgtcgggaagcacccagaaaatccatcacggagctctggagtcccatatcgcacttgcggatattgatgaaaacggaaatctggttctgtggaccccatgccagacagtatatcaggtgcgctttcacatcagcagcctgctggggctgccctatacgaaaatccgggtgatcaaagcggtgatgggcggatcctttggaggaaaaggccagactgtggtcgagcctgcctgtgcatttgcctgctggaagctgaaacagcctgtgatgctgtatatggaccgcgccgattctgtcatagggacgagaagcaggaacgcctgtgagatgaaggtggagacagccctgaccagggaagggaagattctggggagaaggatagctgcggatatcgacggcggcgcctattatacaaatgcggccgcagtggccatggctatggcaaagaagctgttccggatgtaccatatggaagcacagacctgccatgtgagaacctttttcacaaacaccatcccgggaggagcctgccgcggatacggctcaccccaggctcacgccatcacggaagtcaacctcgacctggctgccagggagctttcaatggatccctgtgaactgcgtttgaaaaatgcggcccagccgatggatcccgacccgacgggaggaatgaatctgggaaatgccaggatagaagactgtatcaggacaggaatggaagcatttaactggaaggagagaagagcgaaagtcagggaaaaaaatacggaccggtatgcatggggcgtcggaatggcatgcggagcccacgggaacggatacaagggttcatatcctgagttcacgaatgtgcagatgatgatgcatccggacggctccgtggaggtgagaatcggaatccatgatcagggctgcggtacggttctgaccatgcagcagatagcggcagaagcgctgcacatggacgtatataaaatcaaggtatatgaggcggacacttacattacaccgtatgacgccgccggaacacaggccagccgtgtgacctacgtatgcggaagggccgtgcagaaggcgggagaggctctttttgaaaagctcatccgggccgccggtgttctctacggctgggacagggaggaagtcagcgctgcggacggacagctctgctgcagaggcgggagcaaatcatacggagaagtggccaaagaatatgagaaagcctgttcccggtatctgcgggccgagctggaatatgagccgccctccaaccccggttcctacagcagcgcttttgcagaagtgaaggttgataaatatacaggcctcgtggaagtgacggacttgctggccgtacatgatgtggggcagtgcatgaaccgtacgctggcggaagggcaggtcgaggggggcgcacagatgagcctggggatggcgctgtgcgaagagatggtatacgataagaagggggcaattaagggacgtaatttttcgaaataccatatgatcaatgccccggatatgccgccggttaaaagtattttcatcgaaaaaggagaaccggacggcccttatggcggcaagagcatcggcgaattggcggccgttgcaccgggaccggcagttgttaacgcaattaattttgcacttgaaggccggttttccgattatccggttacgccggagaaaatcatagcatttttggagaaagagagggaacggtagatggataaggggaggatacgccttacgggggagacgctgactctggaagagctggagcggattgctgtttacggcgaaaacgtcgaggttgtggaggaggcgtgggaacgcgtgcgtgcagccagaaaattgatatttgacctcgataaaagaggggttgcggtatacggcctgaacaggggcgtcggctggaataaggataaaaaggtttttgcccagttttatgaccgttataacagaaatcttctgaggagccatatgattggcgtggggcctgagtgcagtcaggaggaagtccgggctatgctggctgtccgcctcaatggttttctgtgcggtcacacgggagtgtcggaagaaattgtggaatattatctggaatttataaaccgcggaattcaccccatcgtaaaaaaacgcggttctgtcggggaggccgatatcggcacattgtcggggattggtcttgtaatcatcggtgagggagaagcctggtacgcgaatgaacggatgagcggaggcgaagctcttaaaagagccggcctggttcctctgcttttagggccgaaggacggcctcggagtcgtatcgtccaatgcgcagggggcggcgtttgctgctctggggctgatagaggcaaaacggtttgttgaacggtaccggtgcgtattctgtctcgccctggagggactgaacggcgtgatggatcccatggatgaaacggtaaacagggaaagaaaattcagcggtcagattgaatcggcaaagaaatgccgtgaaattctaaagggaagctaccttctggaaccatcgcaggaacgcgcgcttcaggatcccttaagcttcagggggcagagtgcggtcacgggcgcggtgacggatgccctgtcttatgcagaaaggcagttagagacggaactgaattcgaccgacgacaacccatgtctgcttccggaagaggacaggatgtgcggaagcgccaattttgaaccgctttcctgggtgcttgcggtggaaatggtatccacaggcctggctcatatgtcgaaaatgatttgccagcagcttttaaggattggggatccgggttttacaaagctgaaccgattcctgactccggaggaaggcgcggttatcgcatacggcacaattcagaagacattttcctgcctggatgctgaaaaccgcatgtatgcaggcccctgttccctggactttttaagcatggcgggccatattgaggatttggcctccaattccacgatggtatcctgtaatatgagaaaaattattgataatctgtattacatggcggccatagagctgatgcacgcggcccaggcggttgatttgagaaaaccaacgtctctgggttttgggacaggaaaactgtttgaggcctaccgcagggtagttccttttcttgaggaggacagggatctgtcctgcgatatagaaaagacgtatgaattcttaaagggatataatacatcaaagatataaggaggaaaaagaagtgagtggagagggtaataaaaaggatgaggttcgttggggagtatttttgccggcatttttgataattggaggaggggctcttctgggaatccttaaaaatgactggctgaccaaaatgtgttcggcaatctttgggtggtctttgaaatcatttggctggctgtaccagctcgtcgccatattttgtcttgtcgtcgtaattattatcacattttctaaaatcggaaatgtcaggtttggaggaaagaatgcgaagtccaagcattccttcggctcctggtttgccatgacgctgaccggcggaatcgctaccggctgtatcgtttacggcgccaatgaggttatgatttactatggcaatatttacggtgaactgtctcagacggggctggcgcctctgtctcaggaagcggcttatttcggtatgggcagggtgttctataactggacgttcatcccgtatgcgatgtattcaatcgtcggatgcgccatggcctatatctattttaataaaaaagaagaactgtcggtggctgcttcccttaccccgcttttcggccagaaaatcaaatacgggttctggcgcaatgtcatagatgtagtttccatagtcgctctggcgctcgggctctcaagcaacctgggcatgggactcgccctgattggttccggcctggaggccgcatacgggattgcccagggaccgatagtctggttcaccttgtttgccattattactgcaacctttacgattgcttccgtggcaggtcttgataaaggaatcaaatggctggctaacggaactacaaagatattttatgctcttttattcttcctggttattgcaggaccgactgtttatatctgcaatatgctgaacgtcggactggctacatggggagagcatttccttcgctggggctttgacccctatataatggacggcgaggccctcgttacctggtggaccatgtttgactgggcctgctggattgcctatgcgcctttgatggctattttctttgctatgatatcctatggcagaacgattcgtcagttcatgattgtaaactggattttaccatcctccttcggcctcgtatggttctccgtatggagcggtactgcgctcaactggcagcagatcggaaaagcggatctgatcggagcgattcagaatggcatagcggtatcgggactctgggagctgcttaaaaagatgcctctcagcgttatcatcataccgcttgtcatgataactatgattgccgctttctcaacaaccgcggacaccatgtccacgacaatttcccaggtgtgtacaaagggctcgcgctatgacagggagccggccaactggcagaaggttctttggggagtatcgattggaatcatcgcagttatcatggttattttcggcggcggccagcagggagtagaaggtgtcaaatacctgtcgggtgtggggggattctgtgtacttcctgtatttatcctgcaattggcagcgaccttcaaagtgttctttattgataagattattgaagaggtagaagaggacgaaataacggttcagcctgaaatgattgcagagctcacagaagcccaggcaaacgcataggaggaaaagaatgaggaaagagaccgaaaagctggaaatggatcttgtaaaaatatttctgtcaccgcctgatacgatgcgggagaagataacgctgtttattatgatggtggtagtctttatcatgtttttcgggccggtcatgttcacggaggtatccccggtaaagggagctgttctctcggcaatcccggcattcaccgtgtcatgggggtggctggtgctgcttcgcagttttttccgcaaaaaagaattttctgtaaaacgctgattatacaaacttatatgagacaggggagctacagctcccctgtctcataggctccgggaatatttttaagtaatgcggcggcctcacgcctgtattcatccggcgcctgctttaatatagaagaaaattcatccggccagcgatgcgtcagttcgctgcaagcaagggctaaaagccccagggactgcggggagttcaaaaggcgggcgctttccccggcctcggcaatcagttctctggaagcggaaaaattgcctttctccgcttccaggatgctcacgtagcctttggtgatggagcgtccgatcagggcggcggaatcattgaaaagtctgttggaaagatagaatgcgtctgcgctttcttctttccgtcccattgcaaggtaagcgcgtcccagattggaatagaagacggcatttccgcaggcatgggcggcttcgcaggtctggacggccttttggtagaaacggacggctcttgcaaattgctgttgcttgcggtaggcttctcccatataattgtagcatccggcgatattcagggtataaatacgcgatttcagaggatattttgagaaaatcctcagagcccgtttcagatagcgcaggccggcagcataatttccttccatggttttaaaaaggccgtagagacggcagtctattgcataatcttcttcaaatcccccttcttttccgagcgtcaaacattccgacagggaatgatccaaatcttttgtactccatatgttaagccggtaaaaattgacgaggcgcaggcagcggatccgcataagaggatcgcgatcggtctggctgttaatcagcagcgcctttttctggcaggcaagcccttctttatattcaccccgggcgatgcagtactgggcttttgtgcgcagcagcagtgcgtacagccgggaaaaagggatggaggaagcttcgttttcaggaagggataggagacggtcttccaagatattgcagtatcccgtaaacgaagggatggctccgttattttccctgtggggagcatattgcatcggataaagctcataattctttatcatatattcttccagagcaaggatacggcattttagctccatcgcctggctgccggcgcggcaatagtggtaaatcaggcattcataatcggatgctccaagcgcctccatatgttttaaatgctctgcaagaattctgtgataataacagcgtcttgatggggacattcgttcatatatcattttcctggtgctgttattgcaaaatacaaaatagggactttgctgttcgaacctttcctcaatgatgccgaggtttttcagctgctccagagtatccaggatgttcagcggattttccctgagcagatcttcaaacagtccgaagcttgctttggactgacaggcggagagcagttccagtacggatgtcccggtatgtgacaggctctctgccggacccgaaagctggcagaaataatccgcttttattgcttttacggcggtgccggattcaacagatgcaggaggcgatatctccagatgggatagtaaattttcctcacagagcggtttcaggatcttattcatattactgcagaaaggaagaacggttccgaaaaacaggatattcggattccggccgcgtatcagcattgaaataaaatcaaggctggctgagtccatatattgaaggttatcaaaagaaagtaccaggggaatctgttcccctatactgtaaaacagtttaaacagcagactgtaggcccatgtgtcaatcgagccggtcaggggaaaaagcctggatgcggcttccaggtgactgggatccaccttgaggtgataacgctccagcaggggctggagctgcagaatcatggtgctgacgggttttaacagcacatccttttctgtttccagacaggatgcctgcaaaataagaaaagaggaattggaaagattccgggtgaaatactcagccaaatatgtcttgccgcttccgtcaataccggaaagcaggatggaggcggattctccgcccatgaaacgctgaaatgcgtccgacagaaaaagcagctctttttcgcgtcccggaagctcttcgaccgcttcctgcaggacgggccgttccgcgttcagggcatcgagcatccggtggtgcagcttttgaagctctttaccgggagatgcggaaagttccttttcaaaaagatgtaccatgcgatcgtatagcttaagccccttgtaataaagtccgcaggctctgtagcgttccatcatcagccggtagatattctcgtccaaagggtcttcttccatatacagccggaacagccgttccgattcttcgacgtcgctgtccggaagaagggaaagccggcggtaaatcagcttcagataagtatgcagggcatagtgcctttttgcaagcatccattcttcgaaagcaggagcgcctttaatatagaagcttgtcaggaattcaccgtgatagacatcggtacattcctcttgtattaactgatcataatccagggtaatggagatatcaggattcaaaatcaattcctggcggccgtacggcaggatgcattcttcaccgagggccttttttaccgtgaagattgcatggcgcagattctttctggctgccgcctcgtcacactgatcccacagaagggacgcggcctgttctctggtggcccttttttctatggccagataatataaaagcgcttcggccttctggtagggaagacggcacggggaagaatcatgtatgattttaggggactgcaaaagaaaaatttcgatggaagccaatagaattctcctttgtatcttttttattattttataacagctcagggagaaatgcaagaaacataacgccgggagccacatggggaacggtgcggcagcagatatacttgcagcggtttttagagatattgaaggctttttatgcaggtttttgtaaaaaaacacacaatcaagcgatcttttctcctccttactatagtaaaagctggaaaagtggtatataatactaactgcaaaaagatgtgaaaaagcagcagaaacatcacgatggataaatttatcatagaggaggaacaccatgcttaaactggagaatatttcttatgagatccaggaagaaaagggacaaaaaggaataatccaccatgtcgatttaacgataaatgacaatgaatttgtagtaataacagggccgaacgggggcgggaagtcaacgcttgccaagctgattgcaggcattattaatccgaccgggggccggatcctgtttaacggcgaggatatcacaggtaaaagcattaccgagagagccaacatgggaatcagcttcgcgtttcagcagccggtgcggtttaaaggtgttcaggttctcgatttgatccggcttgcggcaaaagaaaacatgtctgcggcggatgcctgccgctatctgtcggaggttggcttatgtgcaaaggattatattaaccgtgaagtaaatgcaagtctttccggcggcgagctgaaacgaatcgaaatcgccacggttttggccagggcgtccaggctgtcggtatttgatgagccggaggcggggattgatctctggagcttccagaacctgattcaggtttttgagcgaatgagggcaaagacgaatggatctatcatgattatctcccatcaggaacggattctcaatattgcggaccgtattgtcgtaattgctgacgggcgcgtgattaaggaaggcagaaaggatgagattcttccggagattctggggacgtcatctgcagtggaggcttgcgatttttacaggagggataattaatggatcagattcagagaacattactggaagaggtggccgatctgcatggagtaccggcaggagcatataatatccgcgccaacggacagatggccggcagaaatacgacggccaatattgacattataacgaaagaggacaagtcgggcatagatatcagaattaaggaaggcacgaagaatgagagtgtccatatcccggttgtcttaagccagagcggcatgacggagatggtatacaatgatttttatatcggagataatgcagatgtgacgattattgcaggctgcggcattcataacggcggagacgccgcatctgagcatgacggaatccaccgcttttttatcggaaggaatgccagggtccgttatgttgagaagcattacggcgaaggggacggaaaaggaaagcggattttaaatccgacgacggaagttacgatggaggaaggaagcagcctggagatggagacggtccagattaagggagtggattccacgatcaggaaaacagtggcggatctggcagcaggagccggcattgtcatcaaagaacgccttctgacccatgggaaccaggatgccgagagcagcattattgtcaatctgaacggtgaggatgccagcgccaatgtaatgtcgcgttctgttgccaaggaagattcccgccagaagtttatttccgtcattaatggaaacagccgctgcgcaggccatacggagtgcgacgcgattattataggcaacgcaaaaatccaggcagttccggaactgaccgccaatgatccggatgcagccctgattcacgaagcggcaatcggcaaaattgcgggagaacagattataaagctgatgacgctggggcttacggaagctgaggcagaggaacagattataaacggtttcctgaaatagcaggcatattctcaccgctgtccgcatatacttaggtgtaatatgagaaaacggatgtgcgtatggccgatcaaaaagcagaaaatcttttgaacctggctctcgatgccacggcggaagaacttgaaaaatcacctgcgctgagcgtggggtttaacagggaagaaaaacggtgggagctgatcgtaaaatacaacggagatctgaatgttgtccttgaagcattaccggaaatcgaagcagccacattatctggaggctatgcgatcttaacggtaccgcaatcactaatagagtctttgacaggtttttcgcagatcgaatatatagaaaaaccgaaaaggctctatttttccgtttacagaggtagaagcaattcctgcattaatcaggttcaggaggacggaagcggcctgaccggccgaggcgtcatcaccgccattattgattccgggattgactactatcaccgggattttcgtgatgctgccggaaaaagccgcatcctggaattatgggatcaggataaagataccatatatgaccgtgaacagatcaatgaagcgcttgcagcgggaagccgtgaggcggcttaccagattgtgccgacgagggatgtgagcggtcatgggacggcggtggccgggattgcggccggtagcggactggaaggtgacggcagatacaaaggcgtggcctgggaaagtgatttgcttattgtgaaactgggcgttccggccacggattcttttccccggactacggagatgatgcgtgccctggattatgttgtgaaccgggcggttttttaccagaaaccgctggctgtcaatctcagcttcggtaatacatatggctctcacgatggaaccagcctgctggaaacttatttaaataccatggctgcccaggggaaaaccacagtggttgccggaaccggcaacgaaggcagcgcgatggggcatacctccggtgttctgacggagggaagtgaggtggagattgaactgtcggtggatggctacgaaaccggcttcggcgtacagctgtggaagatttatgcggatatttttgatgtcgtactggtgggacccggaggcactacggtaggtccaataagcagccagctcggctcccagcggatccagtttgcaaggacaacggttcttttatactatggaaaacccagcccatacagcaaggctcaggaaatttattttgatttcatacccaggtacgattatgtggagagcggaatctggaaattcaggctgattccccgccgaattatctcggggcagtatgatttctggttgccgtcggcaagcgccctgaaccgtgccacccatttcctgcgctccacgccggatacgaccctcacaataccgtcgacatcccttcgggcaatctcagtcggagcctataacgattcttatcaggcctacgctgacttttcagggcgggggtttaccaggctcgacaacctggtcaaaccggatcttgcagctccgggtgtaaatgttatgactgccagggcggggggaggctatgagacggttacgggaacatcctttgccgccccctttgtgacgggcagcgcggctctgatgatgcagtggggagttgtaaggggcaatgatcccttcctctatggcgaaaaactgaaggcttttttgatccggggggcgaggcacctgccgggagagagcgtctatccgaacccgagaatcgggtggggaaccctgtgtctggcagattccttccctgtgtaaagcatgatatatagaaaggaatcttgcgtcttttgtcctttttttcgtaactttttagaaaatattaacatattaagggtgttaaaaagtagaaaaatatgatatcatagatagataatgggtgaactttcgagattattgcacaaattgttctgaataagggtgggagcgatatgaatatcagagaaactacggaaaaatgggaacgtgaatatcttagcccttacgcatctttaagcgaaaacaccaggggcagggacagggaagaacctctctgtgatatccgtccggagtaccagcgggacagggaccggattttacatagcaagtcattcagaaggctgaagcacaagacacaggtattcctcgcgcctgagggtgatcattacagaacccggcttacccatacgctggaggtttcccagatagccaggaccattgcaaaagctctgcggctgaatgaatcccttaccgaggcgattgcgcttggccatgatcttgggcatacgccgtttggccattcgggggaagcgattctcgataaactttgcagcggcggctttgcccactacaagcagagcgtccgcgttgtggaggtgctggagaaaaagggcaggggaatcaacctgacctgggaggtgagggacgggatattgaatcaccgtaccagcggccgtccatctacattggagggacatatcgtccgtctttccgataagatagcctatattaaccatgatattgacgacgcgatccggggaaagattttcgaggaagaagatctgccgccggaatatacggatattctcgggaacagtgtcagggagcgtctcaatacaatgatacatgatattatttaccagagctttgacaagcctgagatcgccatgtctcccggtatggagacggcgatgcacggcctgcgcagatggatgttcgagaatgtataccggaacggaatcgccaaagcggaggagggcaaggcgcagcacatgattgtcatgctctatgagcattatatgaaacatattgatgaattaccggaagagtatctggatatgatgagagagcgcggtgaaaaagaagaacgggtggtctgcgattatattgccggaatgaccgacatctacgccatagaccgttttaacgagctctttgtaccaaaatcctggaaagtttaaggaggttttcatgtattatccggaagaagtaatagaagaagtcagaatgagaagcgacatcgtggatgttatttccgggtatgtgaagcttcagaagaaaggggccaattattttggcctttgtcccttccatcacgaaaaatcaccgtcattttccgtggcgccccagaagcagatgtatcattgctttggatgcggcgtgagcggcaatgtgattacctttgttatggaatatgagaattattccttccgtgaggcagtggaaatgcttgccggacgctgcggcgtcaagctgccgaagatggaatattccaaagaggcaaaggcgcaggcggatctgaaagcggcgctgcttgagatcaataagcaggcggccaattacttttattatcagttgaaacagccgcagggccgggcaggctatgattatctgcagaggcgccagctgacggatgagacaatccgccggttcggactggggtattcgaataaaacaagcgatgatttgtaccgctatctgagaggcaaagggtatgacgataccatattaaaggagacaggccttgtcacaattgaagagcgcggctcacgggacaagttctggaaccgcgtcatgtttccgattatggatgtcaataaccgggtgatcggttttggcggccgcgtcatgggagacggagaacccaaatacctgaattctccggagacgaagctgtttgacaagagcaggaacctttacgggcttaattatgccagaacctccagacagaagtttatcctgctctgcgagggatacatggatgtaatatcgatgcatcaggccggctttaccaatgcggtggcatcgctggggacggcgatgacggaacagcatgcggctcttttgaaacgctatacggaacaggtgattctgacctatgacagcgataacgcaggcgtaaaagcggctcttcgggcaatcccgatacttaagaacgcggggatatcggcaaaggtgctgaatatgaggccatacaaggatccggatgagtttatgaagaacctgggtccggaggagttcaaaaaacggattgaaaatgcccgtaacagctttttatttgagatagatgtattaaaagaaggatgcgatatgcaggatccggagcagaaaacggatttttataataaggcagccagaaaattactggattttccggaagctctggagagggacaactatatacaggccgtatccagagaattttttatcaattatgagaatttgaaaacccttgtcaatcagttgggaaaccgtttgggaatgggggccggaagaaccagggagccaggcggggaagagagcgccgcgaaccgtccgggcgcgcctgcaaagaagaaggagaaggaagaaggcatcaggaagtcggagcgtcttctgctcacatggctgattgaagaaccggagctttttgataagattcatggaattatcggtccggctgattttgtaaaaccgctgtaccgggaggcggcgcagatggtttttgacggtcatgaaaaaggagatgttaatccggcatccatcctgaatcattttattgacgacgaggggaactaccgggaggtggcggctctgtttaacgccagtctggaagagtccctgagtaatgaagaacagaaaaaagccttttcggagacagtgctgcgcattaaaaagaacagtctggatcatcagatccgccacgccgaagggctggacgagctgcaaaaactgatcagggatcaggcggaacttgctaatctgcatatttcactcgattaaggagaaaatattaaaaagctatggagggatgtaagaattatggatgaaaagacagtgacatttgaagagaagctcacacagcttttggaactggcgaaaagtaagaagaatgtgttggaaaataaagaaattcttgactttttccatggcgaaatactgaacccggatcagttggatcagatatatgattttctcgatagtaataaggtggatgtattgcagttcgaagaggagcttgagatcgatccggatctttttattgaggaagagctgaatgatgaagaagagatagacgttgaaagcatcgatttgactattccggacggcgtcaatatagatgaccctgtgagaatgtacctgaaggagattggaaaggtaccccttctctcaccggaggaggagatagaattggcaaaacagatggagatgggcaatgaatatgccaaaaagcgtctggctgaggcgaatctgcgcctggttgtaagcattgccaagagatatgtgggccgcggaatgcagtttctggatctgattcaggaaggaaatctggggcttattaaagctgttgagaaatacgactattccaagggctttaagttcagtacgtatgcaacctggtggatccgccaggctattacgcgatccattgccgatcaggcccggacgatccggattccggtgcatatggttgagacgattaaccgcctgatccgcacctccaggcagcttctccaggagctggggcgcgagccgcatccggaggaagtggcggagcggatggatatgccggtggagcgcgtcagggagataatgaaaatctcgcaggatcctgtttctcttgagactccgattggggaggaagaggacagccacctcggagattttatccaggatgaccatgtgcaggtgcccctggatgcggccacgtttactctgctacatgagcagcttatggaagtgcttgacacgctgacggacagggaacagaaggtactccggctgagattcggcctggatgacggaaggccgaggactctggaagaggtgggaaaggaatttaacgtgacaagggagcgtatccgccagatagaggcaaaagcgctcagaaagctgcgccacccaagcagaagcaagaagctgaaggattacctggattaatgaggcaacagttcggccatgattacagtccggcttttggatgaaccgccatacaagaaataagaatttaactgaggaaatttagatgaaattatcacaccgtttagagacaattgcttcctttgttcgcaggggaagcataattgctgatataggaaccgatcatggatacataccgatttatcttgtgaaggaaggaatttccccccgcgcgctggccatggatgtgcggaaagggcctttggagcgcgcaaagcggcatgtccatgaatacggtctggaagacaggatatgcctgaggcagagcgacggcctgcataagcttgaggcgggagaggcagacacgattgtaatagccggaatgggcggagagctgatggtgcgtattctggaggaagggaggcatgtttttgaaagtacagaacgcctaatcctttcccctcagtcggagcctgggcatgtgaggcgttttctcgaaacaaacggcttttgcatcctgagggaaacaatggtcagggacgaagggaaatactacacagtgatagaggcaggccatgggatgatgaagtacggcagagactgcttttatgagtacggacgctgcctgattgaagagaagaacggcgtgtttgccgggtatctggaaaaagagaaaaaaacagtggaagagctgattgaaaagctgtcgcagaatcattcagagagcgcccgtaggcgtcttatggaactgaaggagaggcagaaaattataaaggaggcacaagatgaaatgcagggaactgattgaaatcctggaagaactggcgccggtttctcttgcctgtgactgggataacccgggccttctggccggcaggagtgacaaagaggtgagaaccgtgtatctggctctggatgccaccgatgatgtgattgacaatgcggtggaatgccgggcggatatgattatcacccaccatccccttatctttaaaccgttaaaaaaggtcaatgatgaagatttcatcagccggcgtattcttaaaatgattcagaacgacatatcttattatgcaatgcatacaaattttgacgcggcgcccggatgtatggcggacctggccggcgagcggctggggcttaaggataccagggtgttagaactgatggggaagacggcggaggataaagattacggcattggaatttacgggtgttttggccgcagcatgacgctcagggagacggcagaagccgtcaagaaggcctacggcattccgtttgtaacggtgttcggaaatatggaggggagcataaggacggcggctatctgtcctggagcaggcggcagcacgctgaaggaggctctgagatgcggcgcggatgtgtatatcaccggagatatcggccatcatgaggggatcgatgccgtggccaacgatatggcggtgatagatgccggacattacggtatcgagcatattttcactgattttatggaaaaatttctggaggagagactgggagagcggcttaaggttatgaaggaacgtgatacatttccaaactgtgtcgtttgagtaacaggcttgtctgattaaaaagaaggagggctaatatgccgattgtaacaattggggctgagaaaagggagtacgcatttggaacgccgtttcaggagattgtaaaagattatcaggaaggcatagagaatgatatactgctcgtctcggccgacggaaaactgaaggagcttcataagactttgaaggaagactgtgaactgaggctgattaccgcggccgacagggccggctttttaagctatcagagaagcgcgcttttcctgatgctgaaggcattttatgatattgcaggcaaagataacgtcagcaaactgacggtgtgtttttccatgggaaacggtctgtatattgaaccggagggagcgcttgcgctgacccgggaactgcttgacagggtgaaaacggagatgattcgtctcgtgtctctcgacctgccgattttaaagcgcagtgaaaacacagatgaagcggtggaactgttccatctgcacgggatgtacgataaggagaagctgttctactaccggcgcgcttccagggtcaacatttacagcattgaaaatttcgaagattatttttacggatatatggtgaaaagtacgggctatatcaagtattttgacctgcagctttatgatgacgggtttgtcctgctcttaccttcgagaaagaatccgaaggagctgtctgcattgaatccgagaaggaaactgtttgaggttcagaaggaatcggaacagtggggcaaaaaactgggtgtttttaatgtgggaacactcaatgaggccatttcccagggcagaatgaatgaactgattctgatgcaggaagcgctgcaggagaaaaaaatcggtgatatagcggaaaagattgccggctccgataagagtaaatttgttatgatagccggaccgtcttcttcgggaaagactacattttcccaccgtctctccattcaattgagtgcgcttgggttaaaaccgcatccgattgcagtggatgactactttgtcaaccgggtgaacagcccgagggatgaggaggggaattacgattatgaggcgttggaatgtattgacacaaagcagtttaatgaggatatgacggctctgcttgccgggaagagggtacagcttccaagatacaattttgtaagcggtgagagagaatataagggagattacctgcagctgggagaggaggatatccttgtcattgaaggaatccactgtctcaacgataagctttcctattcgctgccgaaggagagcaaattcaaaatctacatcagcgccctgacccagctgaatattgatgagcataaccggattcctacaacagacggaaggctgatcaggaggatgataagagactcaaggacgagaggctcctctgcgcaggatacgatcaggatgtgggattcagtcagaagaggggaagagcggaatatcttcccattccaggaagaagccgatgtgatgtttaattcggctctgctgtatgaactggcgatactcaagcagtatgcggaaccgattctctacagcgttcccagggactccgaggaatatccggaggcaaagcgtctgttgaaattcctcgattatttcctgggcgtaagcagcgagagaatcccgcagaactccattcttcgggagtttgtcggaggaagctgtttccgggtctagagcgtgttccgctcatattaaacacggtttagttaaacatgaacgtgacaagacaccaggcagttatcagcgcctgtcggcgagatcggcaagagctccgaacagaggggttgccaggccgaaaccgccgctgatggtgagaagctgtcctgttgtgaaggatgattcatcggcggcaaaatagacaacggctgcggcgatttcttctggttttgccatcctctggatgggggactgctttaaaaatgaatcgcaaaagaagccggataatgcatcccggacggcatcggtctgagtcatcccaggcaggatggcattacagcggatgccgtttctggcttcctggactgcgatcagttcggtcagatggttaatcgcacttttagccgtgccgtaggcaacctgggaaatatcagggattaagccactgatggaagagatgttgataatactgccgcctccgttttgcctcatgcagggaatgacggcctgcgaggcggcataagtgttgccaagatttatggttacggtattcaggaaggtttcaacggaggtttttgcgatatccagatccatggccggatcggaagaaccgaagttattaacgaggacatcgatccggccttcggcttttgcgacctcatctgccatagaacggcaggtttccaactgtccggcatcataatggacatagtggatatgctggtttccggtttcgtttttcagttctttgatccgcgtctctgcccgttccctgtttctggcggccatgtatacgatggcgccttcttttgcgcaggcagcgacagcggcaagaccgattccgcgggtggaagcggtgacaaggattactttcttattcagtctcacggcagctcctttactaagatgttttttaataggttgaatttcatatcttattatgtgccggagaaggaattttatgtttaggcgcttttaaacagacttccctgacgtgaatccggtaggggaacaggaggaaacgatattgaagataactaaaacagatgccgctgaaaaaaggcagttgattatatttttgtccgttgcatttgcacttccctatatgatggggattttaatggggtatgcttattacagaggaatagacgtgagctgtttccccaatgcccaaatgtattatccggcagcaggtgtcatgctggctgcgctgctggtaaagaaagaggacaagctggttccgaagaaattctatctctgcttcatcacgattaccgtgctgttactgctgcttacggttggcagcgtgtttctgcccgcgacggggatgctgtttgcaggcctcaatatgattatcacctttggctctctggtctcgtggatttttcttcttgcagagaagaaggaaaatcgggaagcatatggattaagagcacataatggaaaaatttctgtgctgatggttatattgttcttactgctgtatttcgggcgtatattcctgatgtatattgcaggcggacaattggatgaattcatagatgtatttaaaagtccggtgacttatagaatactatttgtattgccattcaattttttccttgtattcacagcatttttcggtgaagaatatggatggagatattactttacaccgtttctgcagcaacatttcggcaaggtaaagggcgtcctcctgcttggaattttgtggggactttggcacctgcctgtcaatgtgttttattacagcccgcatacctggctgcaaagtattgtttcccagcagatcacctgcatcggtatgggaattttctttacgtatacctacttaaaaaccaataatatctgggttccggtgattctgcattttctgaataataacctggtggttattttgaacagtggaaatgcaggcgcaattaataatcagcttatcagctgggcggatgtcctgctgcttctcatcctcaatctggtattattcgtgccttttattttaacgaaggagtttaggggagcggaaaaatatacgggaaagaccgcagactaacggatctaagatacgacaatgcagagcattgctttgaacgttaaatgttttgagcaagacgataagccgggttatgtcgttgaatggccatctatctagctttgccgtcgccggcaaaatcaagcgacctacccggaggcagacgggccgccttatgcctcctgttcggtcttgcttcggatggggtttacatgtgccctgtctgttaccagccaggcggtagtctcttacactgcccttccacccttaccgacaggcacaaagtgcctgtccggcggtatatttctgttgcactgtccttggagtcgcctccaccagacgttatctggcatcctgccctgtgaagcccggactttcctcacctgcagcctttcggtcctgcagccgcggccatttgtcttactcaaaacgttacaagtttatcatattttcttatatttgtccagttattctcagacagcatccgcccggctatatttacaaataatatttctccggacagccgtttcggataacaggagcaaagtctgaattattttgaatatttttcttcacagtactgacatctgtaagtttcttttttttcgtcggcgagatagaaaatatgcggcagctcctgctcgatggaggtgatgcagcggggatttttgcagtagatgacgtttgtgattttctttggcattttcacccgttttttctctacgatatggccgtccttgatgatattgatcgtgatgttgtgatcgatgtatcccaggatatccagatttaccaggtcaaggccgccgtcgatcttgattatatcttttttgcccatcttgctgctcttggcattcttaatgattgcagtctggcactcaagctgttccagtcccagtttataatagatatccatacttttgcctgcctggatatgatccagtacaatgccctcggttaagccgctgatatttaacatggtttttccacctccagtaatgtcatgattaatgccattctcacatagacgccgtactgcacctgcttaaaatatgcggcgcgcgggtcttcgtccacctccacggcgatttcattgactcttggaagagggtggagaacgaacatatcctccttcgctagggccatcttctttttgtcaaggatgtagcagtccttcatccggatataatcttcctcattgaaaaagcgttccttctggaccctggtcatatagaggatgtccaaatcaggcattgcatcatccaggttttcgacttccctgtattcaatatggttggattccagcacatcctcacggatatattccggaacgcgcagctccgggggggaaatcagtacaaaacggatacctgtatagcgtaccagcgcattaatcagggagtggacggtgcgtccaaactttaaatcgccgcagagtccgaccgtcagattgtcaattcggcccttcagggagcggatcgtcattaaatcggtgagagtctgggtgggatgctggtggccgccgtcgccggcattgataactggaatagaagatttggtagaagctaccatcggtgcgccttcttttgggtgacgcatggcacatatatctgcaaaacaggaaataacacgaattgtatcagaaacactttcgccctttgcagcagagctggaatcggcagaggcaaaacctaaaacgctgccgcccagatttaacattgcagcttcaaagcttaaacgtgttctggtacttggctcgtaaaacagggttgcaattttcttgccgtcacatacgtgggcatatctgtcaggattcttctcaatatctgaagcgagatcaagaagctgttcaatttccccgacagaaaaatctaagggatttaacaaatgtctcatttggttctcctttgttgtgctttttgaaaagtattatatagcattttccggcagatttccataggttttgtaaaaaaagtgagggaaaggtttgggttagttactattcacggccaatgtcatttggttaacagtgcaatagatttaactgaggaccggaggacgcgtccggaacggaccatgtccggtgtggtgaggcggctgtctgagtgttccgtccccgtgggaggttgtcgtggagggggaatccggccggaatgaattgctgcggggaccgtttgcactctttggagtgcgcatcagtgctaagctcgtgagggacctcgctaagcaccggcggactcccatgtcccctccgcaattgattccgcctacttccccgttccaggttttctccggggacggaagactcaggcgtaggttttcacacaccggacatggtccgttccgggcgctgattgtctctaaccttaaatggggagggccctgtcgcggccactacgtgtttccgcagacattgtcttcgcccacagccccgaaccacgataatctccctccgggacgaaagacttatatacacaccccaccatcccgtccgctgggcgtaccggcggcgttctacgggaatgccggcacgggaaaaacgaaagcagtttttacggatgaagatactgaggaggaaattttagatacggctttggcggatgatacaacagttacaatatcagccggtatcgaagtgaccagtataggcgaagaaaaatgaaattccggggctttgacttataaaacggattcaggtgatgatataaaagtgctggaatatgaaacggatgaaacagccgctggaggttatacgtggaaggaccgttttaacagggaaatatttctgccggccggtacgaacgaatagcatttcagaaatcatgacggaagcaattaccggatagaactaaacattaaggtaaagaaagactgatatggaaaggagattccaaggcctcagaacgtccttccggcgaggacgttcttttgccataacggattaaactctatccggccaatctttaaatttccatctgctcactttccgtcaggaacgagaggcagtccataattcccgccatataggccagcacattattatttgtgtcgatttcttcccttactgccagcagctcgtcaacggcccggcgctcctcctgggtcagttctaattcgctgaatttccgttcggcttcctgcagcttatcccaatggttactgcagcttcgatccattttataaaattctgcaatcgtatcaccggacattctgtctgccagtctctttaaaattttccagtattcttttttcattattgatgtctcctctaagtatgaattatgttatctgttgtctgttatctgcagtctgcacggcctgaggcggtccccggcatcccgtgctccttccggttttccggccgtatctctgagatgtacatttctccgccggtcttgacggacgaaagttttccatggcataagctccttctactgttgataaaaatgtggtatatggaataaaatcacctcggcccgcccggatacggctcatataaatgaagcgtagatatcagtatcaggacggttttccctgtaagaaaagtttaaggaactttaagaaaaatagggtgggacaaaatcggtctattatgtataataagatagaacaaccattctagcagtccgtaagactgaaatccacaattaatagtcaggactgtcggcagcagtaacagttcagccatgatgtattccgcgaggtgttttcgctgttttttgcgaaaatcccgagttgtgcggcgcgaaacggcgtttttttgccgtttctgtgcatcatttgttacggtttagccgaaggctgaactgtaaccggctgcagaacaatacgggaggaacagacttggaagaaatcggcaaagaacagataaaagagaggattcccgccatacaggtgagaaatttatataaagtataccgtgtcggagagacaaaggtatacgccttaaatggtgtggattttacaatgtataaaggtgaattctgtgccatcgtcggtacctccggttccgggaaatccacacttttaaatatgcttgcgggccttgagaagccgacaaagggggaaattgtcattgccgggaaacatattgaaaagctgaatgagaaccagctggtttctttcagaagggaaagggtcggcttcatctttcagtcctataacctgctgaacacaatgaatgcggtggagaatatagcgctgcccctgtcgttccagggaattcccaagaagaaacggatagacagggcccaaaaatatctggaattagtgggtcttgaaaaggtcggcaggcacatgcccaaccagatgtcaggaggacagcagcagcgtgtgggaattgccagggcgctggtggttcatcctcagattatctttgccgacgagccgaccggaaacctggattccaggacaacgatggaggttctgaaactgatgcagaagattgtgcgggaacataaccagacgcttgtcatggtcacccatgacaaccatctcgctacatatgcggacaggatatttcatattatcgacggaaagatcgtaaagatagaagagaatcaccagcgagccggtgaggagacagaagacagggagggaaaagcagaatgaaaaagtggaagaaactgttggtatttttactggcaattatgataacagttggatgttttccagcatcggttatggcgggggacatgattgattttgagtcatatggcgatggttcagcttttactaatcaggaccacattgaggtaaagaagatatccactggaaagacaggccagaaaatgactgtttcctttgtgatagtcaatgataatacaagtactgatatgaacaatgtcaaggtacagttggtcaatgagagcatatttaaagagatttttgaaatagaagatgaagatgatgaggaggagaccaaaagcagctcatcacgcgttccgaaatatccatttgagtatacctctgatatagccaaggaaaaggagtttggcacgataaaggccgggacgaaaaagagtgtatcaatgagctacaaagtaaagaggaacctgtcagaaggatactatcctgccgtatttaagctgagctatggtgacagaggttattattgctatgtgggtgtgaatatctgggttacaacttcttccagttctacagaggacgatgataacaataaaacagattacgatttttcgattggagacggtcagtttaccccttttgccgcttataaccaggtgatgaattttggcgtcaacctgacgaatacgggattaaaaaaggtctacgacgtgcgggtggagatgcagctcgatgccgatgtgacaaagttcccgtttaatattaacgaaggaaattacagccggaagatgggggatatggagccgggacagatggttacggttccctacagtatggcggtacgggagaacgtaaagtcgggattcttcccgattcattatctggtatcctaccgggaagaggaaaacggcgatttttcagaaccggttgacctgatctattatgtacgtgtccaaggaaaggatgaggatgagctgtcatctgatgcgggagattcggacaggacaaaggccagaattatagtggatagcttttcaacggtaccagaggaggtctatgcgggccagccctttgagttaagggtcagaatgaagaatgcttcatctaatgtcacctccagcaatatcatgtttacctttgcctcggaggaatcagcggacaagagtcctgtattcacatcggattccggttctacctccatggtagtcaatcagttaggacccggagcaacgacggatctttccatggtgtttaaatcctctccgaccgcggaacagaagtcctatacaatgacaatcgttgagcagtatgacagccctgaatttaagaatgcaaaggaagaagtgaagatatcaataccggtaaaacaggttccgagattgaatacaggaacaattgaagttatgccggacagtatcagcgtcggttcggagacgaatgtcatgttcggaattaataataccggaaaggttctcttatataatgtcatggtacgtttcgaggccgattccatccaaactacagatgcctatgtcggcaatattaagccgggtgaaacaggaaacctggacacgatggtctcaggcgtggccccaactgaagatgacggaaaagtgaagattattattacatatgaagatgagaacggtttgacgaccgaagtcgagaaggagatgctcctctttgtaaatgagccgatagatgaactgggaggaatggaagccgggaatatgggagttgatggtatgggaggaggcagcggaatgaatggagccgatggagagcagaccttttttaatcgttataagaaggtgattttcccggctgcagcacttttcattattattactggaacaaccgtaatcgttatcaggaaaaagaagaaggcagcgcaggaagaaggaatggacgatgagattctatgatcttttgtcaatgagtgtcaatagcctgctgaggagaaaactcagaacatttctaacagtcctcggagtggtgatagggacagcatcgattgtggttatgatttcccttggaatcggactgaataaattcacgatggagcagtatgaatcatcaggcagcctgacggcgatacgtgtctataattacgacagaggaggctccaatgataagcagaatccagaagacagctttatgacggatgaaacgatgaagcagtttgagaggattccccatgtggtttcagcttacccaaagattaacatgtctgtgattatgaagcaggggatttatgaggggaatgtccagcttatgggggttcccctgaaggccatgaaggatatcaagctggggcagggaacacttccctcccctgattcaccagagctagagatggtggtgggaaacatggcggtacagaatttttacaatgccaaaaccggtaaggggtattatgactccggagaactgccggatgtggattttatgaacaaaccggtatttacaatatttgacaccaacagctattaccagtctaagtatccgtccggcggggatgagcagacggcggtaaaaccgccgaagaaatatatgctgaagacagccgggattgttgagggagggccggaggactggaatgaatacagttatggcatatacgttgacattgaaaagctgaaaacccagctaaaacagatcttcaagaagaagccgatacccggtcagccgacgaataaaaagggtaagccctataattactttgtctatgagcaggcaaccgtgaatgtggacgacatgaagaatgttattgaagttcagaaagcaattaataatatgggatacgaagcaaacagccagatggaatggctggagcagtcccagaagcagtccaatatggttcaggccgtgctgggcggtatcggagccgtctccctgtttgtagcggcgatcggcattgccaatacgatgatgatgtccatctatgagaggacaaaggagattggtgttattaaagtactcggatgcgcaatgggaaatatcagaagcatgttcctgatagaggccggatttatcggctttgtcggcggagttgccggtgtaatcctgagctacggcgtatcatttctgattaataaattcctggcgggagctttgctgtacggtatgtccagcaagctgtcaatgataccgccgtggcttggatttgcttccatcggttttgccatattgattggtatgctggccggattcttcccggcgctcagagccatgaaactgagtccgctggcggcaatcaggaatgattaaaaccacctagccaactgtcgtcacatcctgtttccatctcccggtggcaatataggcgaataccaggattccgcccccgagggtggcggcagggacggcgattccaattcccaggattcccatattaagacccagcgcaagagcccaggcgacggggatacggataacaattccctgaagaacattgctgcacagagtgatcagggtatgtccggtaccggtgataaagccgttggcggaaaagacaaatgcagtcagaagatagtctgcacagaagccgcggatatacagtgtgccgtaccggattacctcgggttctccgcgggccagtatgctcataaactgcggcgtgaagctgatgcttgccaggaacaggggaataccgactatgagagaaagtccaatcccttctttcaggcaggagagggcgcgctcatattttctggcgccgatattctggcccgacatgaccgccatggctcccgacattgcggagctgggaagcatggcaatgttattgaatttaccggccagctgagcggctgcggaagccgcgtaaccatactggttgatcagagccgtcagaaacatgaaggatacggatgagatactgttctgaacggcagcgggaaagccgattttaataattaaaagaacctttgtacggctgagcctgagattcctgcgtgtcagccggaatatactgctttttctgatcagatatgctgcggaaatgacaaaactgactgcctgggacagtaccgttgcccaggcggagccgttcgggcccattttgaagccggcaacaaataaaaggtccagaaacacattaagggtccctgatatggttacaaatatcaggggccttttagaatctccggttccgttcagaaccgaacttatggcattgtattcaaatacaaaaaaatttcccagcatgcagatttgcatataactgcacgcattctcaaaggactcggcgggagttctgagcagaaccaggaaggggcgggcggcaatgtacatgacggcagtcataaagacggcggctaaggcaaacaaagtcagcaaggttccgatcgtctgctctacatcctccccgcgccgcgctccgacatattgggatattaagacggttccgccggaggcgaaaccgattatcaaaaatgtaaatgcagatacaatctcgcctccaatgccgactgccgaacttccggcagctccgttgacccactggacgatcagcatatcggcagtcatgtacagattttgaatcaggctggacaggaagaatggaaaactgaataggatcagctgccttcttacactgccttcggtaagactgtgtccaatctgcatgaggtgaaactccttttcttaagtttctggttgtacatctattatgataagtcacaaattataattcataaattatcagtgcatccggttttccggaacttgttccggtttttggctgagggtgtgcgcggcggccggcatgaatcagttcgatggagtttacggcgctatggtgtttaatctcatcggcacagtcgatctaataggggagtatctcttctgcatcgagggggaccatacggccgcgtgttttaccggcagaacagtctgacggattttctccaatggttacaataccggcgccgccttttgcgcgttctccgcagagggctatgtttgccggagtaaaatattcttccggcataagattggagacgcccatgggtgtcactgttagaccaatcatacaaaaaaagcagagtgaagtcatttcagaaaacaggcagtttattttaatatttgtgcatcggagcggaaaatgatctagcccaatgctgtaaatggtatattttttattaaaaatattgtataattataatccaggagacgaggtgggacgagatatgagaatcaaaatcgatatgaacggcaattcaccggcttatatacagatgtcggctcagattgccgcggcaatcagggcgggagaatacaggacgggcgataaactgccgtcggaagcagaattctgccatgagacgggactggccaaaggcacggtcagaaagacattcgacaagctggaagaagaaggctatatccgaagagtgcacggaagtggcacttatgttcagggctggcagccggaactgcgcaggatggtgcagtttgataatagctgcaaaaaagaaggaatgaaaccggacgaatgctaccggcttttgaaagaagcctgcggccgtttttttgccgctgatattccggatcaggcagcgatgattgactgtaccccggagatagcgggagatattacgagagaacttgtaaaaatctggaactttgatatgaaatactatcagattgacggagtacgcgccggaacatttatccctccggaggagatatggattacaacaaaaactcattttgaagagattctgcctgtggctgagaaggctggaaaggcacttttgcaggtcaggctttcggttcccgctacggaagaagaggagattgccgctttggatgatgactgtctgctgggcatagtgtatgacagccaggatttcctgatgcatatcagccatacgctggctttgctgggaaggcataatacatattatctctgccagaaagaagaatggtgcgataaaaaaagagccattcggacagaggacatcatatggctggtttccgtgcaggaggaagagattatcaggcagatggagacgatgggcagccattatattgtattcaattacggggtaacgaaggattcattggatgaaatcagggcaattatggagcagagaagaaaatgacagataaaaaaccagagaagaaagaaacgcctgtttatggaaagattgtgggaatgaaacggagaattaaaataattacaaatatatattgacaatttacaaaaaaaatagtaaactttggacaagttatcgattggtagtgaagcaatctgagatattgaaatgtgtgtggaatttcagaaagttttgctaacctttattttagtgaaagcaattctataatcaaatcagtaaggatatcggtatttcagtcattgcttccgttcctgttaacgtattaaggaaaaggagagaagcaaatgaagggaatcaaaaattttaaaagatccaacaggaaatatcttgcgctgcttatggccgcattgacggcagcagcctcattgagcgcatgttccggaagtacctcgggtgatgcgtcacaatcctcatcagcaaaaacagaaaataatggaagcggtgcagccggttctgtgcttcgtgtgggaagaacatgggactccgggagcggcaactttgatccggcaaccttctcggggatctcatttcagtttggcccggatgtgtttgaatcgcttcttacctacaacgacaagcaggaaccggctccgtatctggctgagtcatgggaaacatccgatgatttgaagacgtatacgttcaagctccgtgaaggcgttcaatttcactatggcttcggcgagatgaaagcaagcgacgtcgtattttcagtcggccgccttttggacccggccattaacaacacggcaaccaattcaacaaatctcggcctggccaatatcgaaagcgtcgaggccgccgatgattacacggttgtctttactttgaaggaaggagacgtattcttccctgataaagttgccagatcttacctaaccattaccagccagaaggcagtggaagatatgggtctggaagagtaccagaaacgtccgatcggaaccggtccattcatgctggaagaaggcggtgttcccggagaaaaatattgtacggttaaatttgacgattactggggccagaaagcaaagctggaccgtgtggaatattatgtaattcccgacgatgtaacgcttgccaatgcgatggaagcaggcgagattgatacatatgacgtaaacaatctggaaaaagtggaagagtatatggccgatccggatacttacgttcttctcaacgcaagggattccgcgcagtcctatatcggaatcaatgcgaatttcgagccgttaaatgacccgaaggtacgagaagcgattgcattaagtattgaccgcgatatggtttgcgatgagtatttcaaaggcacggaagaaaaatccaaaggtttccttccaaccttctgccgctatgcactggaagactactggaacccggaatataatccggagaaggcaaaacagctgcttgcagaagccggatacccggatggttttgccatcgacatgtatgctcctaatgatacgctgagcgcaggaccggccacattagtgcagcagttcctgacacagataggcctgaaggtggatctccagactgtggatttcggcgtatggcttgataaggcaaaggccggagaaatcccgatttatctgttctgggattcctgtcctgttattcctgacaacgtgttaaaacagtttacaagcgagagcacaatcaactacattgcttacaatgatcctgagtacgacagaatcgtggcggcagcggtggaagaaaacgatctggcaaagaaagcggagctttacaatgaagcacagaaaaatatcatggattccggctgtctctatacgatgactacatactctattcatcaggttgtcaacccgagagtaaaggaccttaagattacgacaggacttatgcttacctgcagagaggcgtatatcgaagagtaaggttacgacggcaaagcgcgcgggcctgccgcacgcagcctgcgcgctttgcaatgcggtagttgtatagcgctggacaattaccagtacggtataaatttaaggagtagtctatgaaaaaatattttggtatgcgggttttgatggcgatacctaccattttaggcgtgttccttgcggtgtttctgatcatccggatggtgccgggtgatccggcttccgttatgctgggcaaaactgccaccccggaagagatctcactgttccgtgagcagaacggcctggatgaaccgctaatgacgcagatggtaatcgcggtaaagaaattcttcacaggcgatttgggagaatctctttcttcccataaaaaagtgacggaacttttaaaggaacgctttcccaggacgctggagctggtgttgtggggaatgatactgaactccatcctgggaattatatggggcgttgtcgccagtgtgtatcgcggcagatggcccgattacatgattagcggcatgagtaccataggtatgtcgctgccgtcattttacgtggcgattctggtgcttgtagttctggctgtgaagctgaagctgataccggttatcggcattcaaagtgaaaatgccaattactttcagaccattgtagctcctgttcttacgatggttcttgccggaagcgccctgaccatacgtacgaccaggtcaagcatgctggaagtgatgggagaggatttcatcagaaccgccagggcaaaagggctgagcgaaaaagccgttttatttaagcatggtctgagaaatgcggcgattccgattgccacgattatcggatataatctggcatccagtttcggcggttccattgtaattgagacggtgttcaacaggcccggtatcggaaagcttttgatggacgcggtgacgaagagagattatcccgtagtccagggaacggccgtattcatcgccattctgctgattgtcgtaaatctgttgacagatgtcatgtacagcattatcgatccgagaatccgtgttcagtcggacaaataaaggaaaggcagttgggacaatgagtgtaatacaggaatgtatgcaggataatgacaatatcctgcaggttgaaaatatatgtaaatactataaagccggcagcggcagattatttgataaaacagttttcaaggctgtcaatcaagtgtccttttctgtaaaacgcggagaaaccttcggtctggtgggagaatccggctgcggaaaaagcactctggcgaagctggtcatgaaactattggaagcatcgggcggcagggttttgtttgacgggcaggatattacaaaaatgccgaagaggcagctggatgcgatcagaaaggatatgcagatagtatttcaggatccttatgattccctgaatccccgctttaatttaaaacagatcgtgtccgaaccgatggaaaatttcggatacagcagacaggaaatcgatgcgcgcgttaaagagctgtttcaggaagtcggcctgccggagaagctgatggtgcgctatccccaccagttatcgggagggcagagacagagactctgtattgccagaagcctggccctttcaccgaagctgctgctctgcgatgaggtggtgtcggctctggatgtatccatacaggctcagatactgaaccttctgctggatttaaaggataaaaacggcctcacctatgtttttatttcccataacctggcagtcgtcaaatttgtttcggataaaatcggagtcatgtatttcggaaagctggtagaggtagcgggaaaggacgagctgtttgaaaactgcctccatccctatagctgcgccctgctctcggcagttcccatccccgatcccgacgtgaagacgaaacgtctgatattggaaggcgatcttcccaatcttatgaatccgccgaagggatgtatcttccaggacagatgcccgtttgtaaaggatatctgccgcagggaggagccggagcttaccgagtttacgccgggtcatcaggtagcctgccacagggccggagaactcgatttgagaattgttgaggaataggcaggaggataaagctatgattaaatttttgaagaaaaataaggggattggggccggcctgttcatcctgactatcattgtctgtctggcggtgtttgccgactttttaactccttatgcatttgatacgataacgctgtcggataaattacagccgccaagcgccgcccacatcatgggtacggataatttcggccgtgatatctggacaagagttatctacggagccagaatttccctgaccgtatcgctggcggccgtggcgctgggactggttctcggctgcctgctcggcctgatgggcggatacttcaaaggcccgtttgactttgccctgggccgtgttatggacatattcatgtcatttccttcgattcttctctcactgttaatcggaatcgccctggggccgtccattctcaacatgtgcctatccctgggaattccgctgataccggcattctaccgcgtcacaaggggagcggccctgaatgtgggggagagaacttatgttatggcggccaggtccatgggcacgaaaagcagtaagattttgttccgccacattctgcccaacactctgccgcagatttttgtaattctgtccttcagtgtcggcggctccatcatggcggaatcttccctgggttatctgggcttcggtattccaaagccgacaccgtcctgggggcttgtaatcagcgagggcaagagctatatattcaacgccccgtggattgccggtttttccggcctgatgattgcgcttacaatctttgcattcaaccttttgggagacggtatcagagattacctggatccgaaattaaaataatggcagtgacgctttaggaggtacgaagttggagaatgataaaattttggaaataaaagatctgtttgtaaaatttccaatggacggcggagcaattaatgcggtaaacggcgttaatctgtcactgggtaaaggtgaaactctgggagtggtaggcgagtccggctgcggaaagagcgttacgatgtcaacgattctacggcttgtaaagacgccgcctgcaaggattgagggggaaatttactataaggggcagaatattctggatatgccgatgcgggattttaccagaatcagggggaaagagatatcaatgatatttcaggagccgatgaccagtctcgatccggtcattaaaatcgggccgcagatagcagagagcctgatgctgcatgaaaaacttctgaagaatgcggctatggcaaaggcgctggaacttttgaaacaggtggagattcccaacgcggaaaagcggattaatgattacccgcaccagttatccggcggtatgcgccagagagtcatgattgcaatggcgctggcctgtaaaccgcagattctgctggcggacgaaccgacgacagctcttgatgtaacaatacaggcgcagattatggatttgatcaagaagctgagaggcgaatacggaatgagcatcatgatagtaactcatgacctgggtgttatttccgatgtagccgatcgcgtcgtcgtattttacagcggccagattgttgaggaggcccgcacggccgacctctttaagcatccgaagcacccttacacaaaggggctgctggcatgtataccgaccctgcagacaaaagcgcagcgcttacaggttatcgaaggaaatatcgcagatccggcaaaccgcccaagcggctgtcctttccacccaagatgccgttatgcgacggagcggtgcaggaaagagaacccgaagctgtatccatgcggagacggccatatggcggcctgccatctgatggaagataacggctgacggcggatgagcaggaaaggaaaattaacagaataaaggaacgggacggccggttaagaaaaatggaagacggccggttaagttcaggaggaaactatgtcaagaataacgactgtatgcggcgatattgcgccggaagagctgggatacaccgatatgcatgagcatgtgatgttcgacggaacagatatgggaaacatctgccgccccgggatgccgggaaatcttccaatccaatgggaagataagatatcgttggaaaatatcggccttttgaagcgtaacttcacgctgtgccgggatgcaatgaatctggacgacgaggaggttatgacgggagaggtggctgattataaagagtcgggaggggattcacttctggaactgagtgttcccgggatccggctggacgtggctgcaatcaaaagaatctcagaaaaaacgggagttaacattattacggcaaccggattttatattgaatcatcgtggatgggccgttttgacggatggaatacagcggatttctataaacgtatcatggacgaatttgagaacggaattgagggaaccggaataaaaccaggatgtgttaaaatcgctctttccagcttcacccaaagagaggagatgtccctgagggcaggcgggcaggcggcgaaggaaacgggaatgtccataacggtgcatccctgcggccggggaggaggagaacccggtaaggtggtggagatcttaaaggaagaaggcgtaccggcggaaaaaatagtcattgcccatgtgccgatggccaataaccggggattatctgagatgattcgctatccggagctgtgggcgcttaaccttgatgtggcaaagtcaatactggcggaaggagccaatatatcggtcgaattcatgtcggggcagatagatttagaggcgctgggctcccagtccaatccggattatatgaagctggcaggtcttgtaaagctgatcaatgaaggccactgccgtcagatggtgctggggaccgacatgtgcgtgaaaacaatgaccagacgctgcggcggagagggctactgccggctgaccaaatttgccgtgccggcattgaagcagtacggcggtgtatcggattatgctgtcagaagcatcatgattgaaaatccggccaggattctggcgtattaagagccggaaataacagcggattaaatgaaaactataaacttaatataaaaagaaagaggtataaaatcatggcagaaatgtacaaagtaaaattaaccgtattaaaaacagcaatttatccggagctggcagaaaaatatttatcgatcggaaaagaactgaaaccatgcggcggctttaaggaaggccaggaaattattgtagacgcctttatgaactgtccggagggcttctgcgcccaggcctgggccgcgctctatccacagatgcttactatcagccgcggcggttcctatgcgccatggacaaaagaggatggtgtggaagtcggctgctgtacagacggcctcagaccggtgacattcctgatcgagagagacgaagtacagccatttgacgtatagccaattgaataatcccccctgttatgatatactatgagcacttgatgaggttccccacgaatctagtgcgagtcatatctggacacttagcgaggtattaaacgagcttagtgaccaggatatactatgagcacttgatgaggttccccacgaatctagtgaacatgatagctggaggcatatatggataagcaggacaagattgcagtactgattgacgcagaaaacgtttctaaaaagtacattaaactgattatggatgaagtgagcgactatggaatcgctacatacaaacggatttacggtgattttacaaatcccagtgttatggcatggcaggatgcgctcagagattttgcactgacgccggtatttcagtttaactatacgaaaggaaagaatgcgtcggactctgccctgattatcgacgcgatggatatcttatattcgggaaaagtaaatggattctgtctggtaacctccgacagtgattttacgaagctggcgattcgtctccgcgaggccgggatgattgtaattggaatgggggaacagaagactccgaattctctggtatcggcctgcgagacattcaaattccttgatttactgtatcaggagagcctggaagaacaggcggaggacgagaagctttctgaagttaaggcagcaaaagcggcagaaccgcctgcggcaatccgttcctcggacgaacgcgatacgaagaaagccccggaggcaaagacaaagccccacccggttgaaactgcggatactccggatgacaaagccgacaatttaaaggatgatgccagactcaacaatgtgccgacgaaggaggaaatcggcgctgagatagtagccataattgagtccagatccgatgagaacggatggattaaccagtcggagataggaacggtacttccgaaaagagttcctggctttgatccacgaaactataaatgcaagaaactgggccaatttattgaaagctttgattatcttgagacaagaacgatgaaaaatccgaacaacaaattattaaaagtggtttatgtaaaaataaaacagcagtaaatgaaagtccgaaatcccggaaatcccggagatttcggacttttaagtattgaaggcagcggcctgtgcgcggagcgtgcagaataacggtatgggattatgcaggccggatttacagtattgtaaattgtatgtataaatattgaataaaaaaagcaaatttctttaatgactttgcttactaaaaatgttatccttgaatcagaaataaattccacacacaatttttccttacttaatttaaaacaacaatagcgataataataacaaatcaattcagtgtttcttttgaattaaaaatgagctcacatagtaaaaaatggtgtacaccgggagactgcatatcaatttgatatgattattgtctgtcggttttttcattcaaagctatggaaaaaggaaagatttatgatacacttgaaacaaaaacagactacaaggagtgctgcagatggattcgaacgaaatatttattaaagatattccagcatttttcaggaggtttaaaggcagtactaaagacgggcagtatgatctgtattgccaggagtttgcttacagtattatatatggaaacctgaacagcagccatgtggatgaaattcttcagttgattggattgagctgtctgcctgaccggcttttgctggtacagacagactacaatgatgtgttccagttttatcctgaatttaatcagtttcccaggagatttaaccagacgcagacgcttcaaagatgtgtgaagcgaagcggaattgaggggctggtcgcatcctacccggcgcggggcgtggtcggtgtcttcctgtgtacggggcaggaatcgtcttctgaagagaaagtaataacggagaaaatcagggaacttgcaaaggatatgattgtacgggtcaacgaagaggtgggagagagtgttgcgattgggataagccgatattgcagcagcctgtcgcgtttcccgcaggcttatgccgagtgtaaggagggactgtttcactgcttcaggctggggaaaaaccacatggtatttcataaagatatatgcgaacccaagacaccgttttcacgggatgtgctgaaaacctttggggctgagattgtctccgggatcacgaatggagagcgggcggcggtaaaggaccatgtggatgagatgatgaaatacatgctgtccgtggcaatgtcgcccattaacatacgtctgatcctggtgagttttgtagatacactgagagaacgcttttacaactccagaataccggccgatatattggaaaaagcgtatctgaacacatccaaacaagtcataaacggcatgtttgcagacgatataaaggagacgatggagcagttctgtgatatgttgataaaagaactgggggcggagtcgcaaagttccgaggaactgctgtttcacaaaattgatgaggccattgaaaaatattatcccaacagtgagtttaacctggatgtaatggcaaatctgttccattacagctcctatcattttggccgtctctttaaaaacacacggggagaatccttccgacagtatctagccaggtaccggatcgagagggcgaaagaatttctggccaggggggacaagccgaatgaagtggcatttcagaccggatttaacagcatcagttatttttgtactgtttttaagaacctgacgggcgtttcaccgaaacagtatcaggagaattttataaaataatcggaacggatatagttccaggcggtgacctgtgcgcagagcgtgcaggttatcgctatttatttgtctatatcgagccctttgtcgaaagaaatataatttatcatttactttattagtaaaaatatagtattatattattttgtaaaaacagatcggattcagcagggggaggagtaatggacgttgaagtttttgacggaagtgaaccggcatataaacagctttgtgaaaagattataaaagcaataacagagggagagcttaaacctggtgacagacttccctccgaagcggcgctgtaccattctaccggtctctccaagggaacgatccgcatggcctatgaggagctggaacataaggggtgcattaaaagaagcaggggaagcggaacctatatccaggaatggagatcggaaagacaaaaaatgcaggcttacagggagaaggttctcagggccggaataccggctgaggaggcatttcagctgattgaggaggcatgccggaaaaaattcagtaaaaaggaagaggtacaggctgccctttttgactgcacgcctgaaattgccgcggatatctcccgcaaaatagaggagcgatttaagttccttccagtatgttatgacgtttatgaagtccttgaagcattcggcggtattgtcccggaggcagaactctggctgacgacgacggctcattatcacgaattacagaatctggcaaaggcctataataaaacactgataaagttacagatctcggtagacgacaaagtagtggagacattgtcggggcttagcggttcatgtatagtgggaattatctatgagagccgggattttattaaacatgtaagccttcttacatcatctctgtgtaagcataatacgtattttatctgccggaaagacgaatggaaggacaggaggagtttacttgattcaaaacctgtctgttggattgttccggcccgctatgaggaaatgaagacggaggcggaaaaagaggagaatatggatgtcctgttttaccgttataagatacttcctgattcctatacagacctggaagcatatctgcaggaggtatagatgaaagagaaaacgccgatttatagaaaaatcataaaagatatccaggataaagtggaggacggaacatatcaatccggtcagaaacttccgagtgaaagggaattatgcaagcaatatcaggtcgcacgcggtacgctgaaagcagctctttcacaattaaagcaagccggacttctggaacaggcgaggggaagcgggacatttgtaagagaaaaaggaaaaaagcagtcctgttatcaaaacgctaaaaaactggtcgacgagctttatgcaatgcacctgacggaggaagaaatactccggctggcaagcgagatattattggggcagatggataattaaaccggggagaacgctccggactataccactttgtaaagcgtatgtatgaatattgttgaaaaaagcatatttctttaatgactttacttatcaaaaatgatatcctttaaccataaagaaattccacacacaaatttccttacattttaaacaagtctattcagtgattctctgaacgcaatgtgagctcacatattaacaaatggtgtacaccgggagacagcatatcagatatggtatggttaatgtctgtcggttttttgttgaatttttgaaaaacgggagatttttatgaagcaaatgaagacggagggcaaagagatgccggtttcggcagatcttgtgtttttcaacggaaagatagcaaaagtcgatcggaaatttggcttttgcactgcaattgcggtaaaggacggatggattattgacatcggcagtgatgaagaaatgaaatgccacatcggagaagcgacagaggcggttgatttgaatggcaggctgatgctccccgggtcccaggactgccatactcacgcctgcctggcggggctttataaaatgccatggtttctggacgtgggagcggataaggtgtcctgtcttgccgatctcagaaaaatcctcgctgaggctgcggcagagacgccaaagggtcagtggatcatgggatccggcctcagcccgggcagtattaaggaatgtgccgatgcacagcggcagatcacgcggtgggatattgatgaggcggtgccggagcatcccgtatggctggctaacagcggtctgcaccatatacttgttaacacgaaggcgctggaactggcgggaatcacaaaagacacaccggatttagagcgacatgagggaaagattcagagaagagaagacggtgaaccgacagggtatctggacgactttatgctgatggacaaagtcgggagagtttcgccccggctgagcgacgggcagcttcgcgaatgcatcaggctgattcagaaagaaatgaatgaaaatggcgttacaagccacaccgatatggtcggaatcggaggggattatctgtttgccggtacaggcggctcccgggttatcgatatgtatgagcagatggccaaggagggagagcttacggccagagtttccgtaaatattatggcggggctgaacggtctttccacttatgattcgattatcggcggagccgccgctaaaaaggttccggcactgacggacagaaaatgggtggatgcctgtgccgtcaagctgtttggagacagcatgtggctgcgccccgacggaagaaaaacgggagggagcagttattttcccggtaatacaatagaagagcagcaggaagaaataacacgaaccatcgtggagctacaccggatgggataccagataggaatccattccaccggaggctgtgggatcgataccattgtggatgcctatgttaaagcgatggagctgtaccccgggaaaaacctgcgccattttgtgattcacggtgacgatttctcggaagataacatgaagaaatgcgcaaagaaccatattgtgctgtcctcccaggccgtggctccctggggattcatggaatccctggtggactgtgtggatccggaagaaccttcgcatatgttcgattaccagagatttatggataacggcgttgtcgtaagccagggttccgacgccccctgcatgaccgttaactggctgatgggactgaagttcgcgatgacgcggacgactgtctccggcacctgctataacaggggaaacggctgtacgattgaggacggaatcaggatgtatacgattaacggcgcataccagaaccacagagaagatgttacgggcagcattgaggttgacaagctggcggatctgcaggtgcttgacaccgatatctttgagatatccccggaacagtttgacgatgtcagggttgtgatgaccgtgacgggtggaaaaattgtttattcccgggagcaggattcaatcagaagtgtctgagaaccggaaaccggaacgataaataagtaagagtaatacaataaaaatcaacaggagaagtcgaatatggaatatacgtatttggggcgtacggggctgaaggtgagccgcttttgccttggaacaatgaattttggaacatccaccagcgagaaggatgcattttatatcatggataaggcggtggatgcaggtattaatttctttgatacggccgacgcctacggcggcttcgccggcgagggagaacacggactgacggagaagataatcggaaagtggtttgcccagggcggcaaaagaagggaacgcgtaatcctggccacgaaagttttcgctacgatggaagagccgctggaggggccgaatgacgaagacggcttgtcggcctggaaagtccgcaggcatatggaagactcgctgaaacgccttcagacagaccatgtcgatctgtattatatgcatcatatcgaccgccatgtgacatggcctgagatgtggggagtgatggaagttctggttaacagcggaaaggcaacctacatcgcatcctccaactttgcaggccacgatttggtccgggcgcagtgggaggccgataaacgccacttccttggtctggtggcggagcagcaccaataccaccttctgtcaagactcccggagctggaagtgattccggccgccagggagcttgggctgggctttgtcacctactcacctctggcaggagggatgctgggagagaatgccctgaaacgcctgagcggatcgcgcggtgagaaccgtcactattccgaggcgatgattaagacgctcacggacttcgcggatttctgccgggaactgggagagaagcagtccgatgtggcaatggcatggattctgaaaaatccggttgtcacaagccctctgatcgggcccaggacgccggaacatctcgataatatcctgcatgcgctggatgtaaagctggatgacagcgcgatgaaacgtctggatgaaatcttcccgggaccggggggagaggcaccggatagttatgcctggtaaaggataaggataaaaagatataacaggtaatttttaacatgaacagacggtaacagaataggggattctctgagaagagaaaagcccttcttctgttaccgtctgtttcaatttggattcgcggtgaaaggtaattcacgatccattccacgtggagcgtgactggcccgcccaactgttatataccacgcggtaaaattcagagttttttttaaagtggtcgccgttgttttgtgatgataattctgtaacaatatgttaatattctggcatggatgcatatttttataaaatatacaaaaattacaggggataaaggggtaaaatttactaattcgaaggcggagaggggtaagtaattgaaatattcatttatataatatcacggatttaaccgtgaattgaaaggagccagaatatgaaaaaaataagattactgacaacagcggcggcaatagcgctctttgcatcaatgatattgaccggctgcggcggaggcgggaaagcggcggacacaggggggagctcagcagttcagcaaagctccggggacagtggtgagaagatgctgaaagttgcaacacattgggagaaggccacctttgatccggcactctggggagacggaggcagtgtcaaggcaggtatatccatctttgaaaccttactggccctggatgaagacagaaacctgattccgagcctggcggagagctgggatgtatccgacgacagaaaaacatatacctttcatctgagaaaaggtgtccggttccatgccggctatggagagctgacatcggaggatgtggcatacacactggagcgcctgagtgatccggaggtaggggctaccgatacgaaatcaaaatgcaaggtggacaacatcgaatccatggacacatcagatccctatgtgtttgtactccatttaaaggaagcagacaatgagatcctgatggattttgcgtcatggtatacgaacataataagcaagaaagcttatgaagagcttaaaccgtcgggattcggtgcaaaaccggtcggaacggggcccttcgaatatgaatcgggcaaaccggcggaggcatacatcgttaaacgatttgatgactactggggagaaaaagcactgctggacaaagttcagattacaatgctggctgacgagtcgagccggattaacctgtataacgcgggcgaagtcgatatcatgtcattaaatgattccaacaatatcctgaaattcggagaaacagaggggtgcgaggtgaagaaagtcgcaggcgcaggctgttactacctgggaatgaacctggaaaaagagccgttcaccaatccgaaggtcagggaagccctgaaatatgcgatcaattatgacgaaatgctcaacgactactggagaggaacgctgttcccgcctaccggctacgttcagtcctactgtatctatgccagtacggcagaggagagcggctttacatatgaatataatcccgaaaaggcaaaacagcttttggcggaagccggctatccggacggattttccacatcggttgcttctccgaacgatacgctgtcaaaaggaccgctgcttgtgatccaggagtatatggctgatatcggtattgatatgcagttaaatctttcagagttcgctactttcctcgacgatgtaaggaacggacgccacgatatgtggttcctggttaacggcgacggttaccgcggcgatcagtggctcacctccttcaccagcgaaaagattccgggaagcaactggtgtcagttcagaaatgaggagtttgatgaacttgtggcaaagggctttgaagcaacggaaaaggccgacaaagataaatattttggagatgcccagaaaattcttgtggagagcataccatcgattccgattgcggaatcaacgggcgatatccttgttaaagatacggtaaagggcttctcacttaatccggaactccttttccagtttaagtatatggatttgcagtaattaacggctgcgttttctgcggcagtgaaccacaaaaaatgctgccgcaggaaacggatggaggggaaacatgaagcgttacattttaaaacgtctgttatttgcggttcccacgattttagggagtatgatggtagtgtttctgattatacgttcgattccgggagacccggtagcgatgaaattcggtaaatcagccaccgtccaggagcttggatttaccgatatgcatgaacatattctgatgaaaggacgcattttcagggagcagttcaaagaggaacatccgggatttaaagagacggttggagaggatgaaaaaaatacgctggaaaatatcggaattatccgcagaaataatatgtttacctgggatacccaggatctggacgatccggccgttatggaaaaagaggttgccgattttaaggcggccggcggccggtcgctggtggaaatgagcgtccccggtatccgcggcgatatccgggcggttaaaacaatagcacaaaacacaggggttaatgtgatcggtacaacgggaatttatatctatgagtcctggccggagtggtgccacgaagcagagataaaagattttatgaattttatgaagcaggagatcgaggaagggattgagggcaccggcatccgcccggggatgattaaagtcggaatttcttcgggatttcgtccgagggaagagcttctcctccgggctgcggccagaacggccaatgaaaccggtctttcactgacggttcatccctgtttcaccatgggcggaggccccctggaaatagctaagatcctgaaagaagaaaatgtggatatggagagaaccgtcattgcccatatgggggcatttctgggagaaggaagtctgaagacattgattactaaccagaaaagctggggaatcagcctcgattacctgcaccgggtgcttgatacgggggttaacatctgcattgaaatatgcaacacctccgacagggaagccacaggctccgccagtattccgggatggatgaggctggcggccgtatatcagctgattcaggaagagtatgcggctcagcttgttctcgctacggatacgtgtgcaaaacatatggccaggtattacggcggagaagggtatggacgcctgacccggtttgccattccgacactccgcgatattgtcggggtttctccctatgccattaaccagattatggtaaagaacccggccagaatactggcgtattagggttactattcacagcccaacatcatgacgttgagtaacatattaggaggaagtcacaatgcagagagcagacacgattttagtgaatggagtgatttgtaccgttgatccgtcatttcgatttgtacaggccctggctgtgggagatgataaaattttgtattgcggaaataaccgtcaggcgcttcagcttcagggagacggcacaaagatcatcgatctcgaaggaaaactggttctgccgggaacgtttgacgcccatatccatgcggcttacgccggactcagtctctcccctgattttgtcaaagtggaaccggaggatgcctccaatctgaaagaattgaatgacagaatccgggaaaaagccgggaacctgccggcggatacctggattatcggctggggatttaagatccggcaggtagaagagtgggccagggaagaacggatgccgacctggaaagatatagaagagggttcactggggcatccggtcattctcaacgacggcggcctgcataccatgctggtcagcaaacaggcgctcaaactggcggggattacaaaagatacccgttttaaaaaggaagagggcatcatgttccggtttgaagacggcagcccgaccggcctgtttaccgatttcgggactcaggcagcggtgggaagagcagcatatcatctgcagggacgggagatggatgaatgcctgatacggatgcagaggaagatgaacagctacggcattacctcccataatgatatcgtggggccgggcggtaatgatatttgtttcggcacctacggtgaagaagcgatccgtggttatgagaggcttaggagagaagggaaactgacagcccgcgtatttatcaatctgctcgcgggaaagggcggtgtccagagctatgataccattatcggaggactcgaagagatgaatctgcctgaatttggcgatcggaagtgggttcgggctgatgctgttaaaatctttggggatgacggctgggagcgggatttgccgccggaaaaaaacggctactgtatgtttccgggagagacacaggaagagcagggggaagagctgcgaagaacaatcagggagcttcaccacaggggctggcagacggcgattcatctcacaggaggcagggggatcgatatctcggtggatgctctttcagaagcagaggaagaggaacctggccgcgatcttcgccattttatactccatgccagcagttccagtaaagaaaatattaaaaagtgtgtgagacatgaaatagggtgcggggcacaggcagtgggcggttacgaatttggcggggagacggattataaaatcctgctggacggaggtatgctggttgctgagggttccgatgccccggccctgccgatgaactggatgaaggggctgcatttcctggtcagcagaagggcaaaggacgggaaggtatatcatcctgaaatggctattgatatcagagaggctgtccgtatgtacacaatctatccggcataccaaaaccatgctgaagatatctgcgggtcactggaagtgggaaaatgtgcggatttacaggttctcgaccggaatatttttgaaataccggctgacgagattgagcatacggaagtgcttatgacgatgtgcggcggcagagtcgtttaccgaaaaggtgacagtatttaacactagaaaaagagggacccgtacgcatgcgggtccctctaagctattttttcctggaaaaattgtatgctttcatcgttgtgcgtacgctctttccacgcttattttctcttttaaagccaatcatccggccgggatcggcttcaccaaccaggataccgggtttttgtttttttgccagaaccataatgtctgccgcatcctctcttgtgaagaaaagccgccggttcctgtcacccttgctgatatggagggccaccagctccggatgattcctatcctcaagcgtcacggaatcaatctgctcccagctccagaaatcatactgtgtggtaatatgcatctgataaaaaatttcaagcccgcgcttggtgattaccgtatccttttgcatttttaatgcaagtatgtataacaggccaaatataaatgcaacgcgatacggtgtaatgactcctgcagccagaagcaggccggacataaaccaactgcctgccgtaacccatttgctgcgctgctttaattctctggcatgatattttgggccggctgttaattcccatgggagataatctgctctcgttctcacataaaaccattcctttccgttctactgttatcagtggtcaggctttctttacgccggttgggacaggggccttgccggcagcacggagagcttccagtctttcaagggcgtacgcatgttctttgggaggcgcagcggccgctttacgcattgtggtcttaccgaaaatgctggtataggcgccgtcggcccagaacacattgcgtttcaggcaggcggtgatcccgccgtaaatcggattcagaagatttacaaatgcatatgggaaatatacgaaggggtgcacgcccagggttgcatactgataagcgccgcagccggtccacgggaacataacggcccacagggtcccgcagtcctcaagggtacgggaaagcatgtttcgggccaggcccatctcatcgtatttatctctgtacagggggccaggaacaccaattcccaggaactggtcacacatggtagcgtcgcagaacagggatgtgaccagggttaatacaaccagacctcctacattgtggattttactcttgataccgctgaaaagtgtttcgacacagccgcaccgttccagcgctccgccgtaggctacggccagcagtatcaggttgatggtccacatctggtgatccatgccgccgcggctcagcagattgttagccagttcattgctgctttcaaatgtggttccgtaatggagaatgttaaaaatatcactgacattagtgattccctggaaaacagccccaaagaggacaccgcagcccacggaaatggcgaggcctggcaaggccggcagttttaacacacatacaacgacaaccacaacgatgggcaacagaagcaccggatttaagttgtatccgcctgcaagagcctgctggagttccagggcaaccgtgttgtcatatccggtcgttgaatagccaaaacctatgattgtatacaggaccaaagcaatcacgaaggttggagccgttgttgataccattgcggtaacatgatcaaagaggcctgtttccgagactgcggcggccagattggtggtatctgacagcggagaaaatttgtctcccacataagctccggatataatcataccggctgtcagcgcaaccggcatgcccaggccggctccaatccccataaaagcaatacctatggttgcggtggtggtccaggaagaaccgcaggccagaccgacaacggcgcacaggatgcagccgaccggcagaaacagctttggagtcagcagatccagtccgtaatagatcagggccggaatcgtgccggacatgataaaagatgccaccagaatgccgaccgtgcaaagaataagaatcgcttccattgtacggttcagacagtccagcatacctgccatcatatctgaaaaagagtggccgcagatacagccgataatacaggctacaacaatggagacaagcagcggcatatgcgcatctccgtaactggtgccggccataaagtgatacaacatcaggcctaacattacgacaatgggtaacaatgcctcaaaaacgttgggaagacgaaccgtacgctgttttttttctttttcactcattttaaaccctctctcctaatatataagtgtagggtttcagtacccaacagccagttgggacttaatcctctcattgtttaagctgtataatgattaggcattggtatgacgacacctcctaggaccactttaggtgtccgcaagaaagccagtcagccagcctatcatttgcagccgttcgatttatgcaggttggactgtccttgtacatgtccgtttgataccccaggagattgaataagcagtgaggaatgctggataccatgcaaattcattttcaggaggtacattaggatgtacaacgctgtcggtattgatgtctcaaagggcaagagcaccatcgcagtcctgcagcccggaggcgtcattgtcaggaaaccctttgatgtttttcacacttcccaatccttaaaagaactatcaaattatctggcttcacttgaaggggatacaaggattgtaatggagtgtactggcagataccatgagtccatggctaactccctcctaatatataagtgtagggtttcagtacccaacagccagttgggacttaatcctctcattgtttaagctgtataatgattaggcattggtatgacgacacctcctaggaccactttaggtgtccgcaagaaagccagtcagccagcctatcatttgcagccgttcgatttatgcaggttggactgtccttgtacatgtccgtttgataccccaggagattgaataagcagtgaggaatgctggataccatgcaaattcattttcaggaggtacattaggatgtacaacgctgtcggtattgatgtctcaaagggcaagagcaccatcgcagtcctgcagcccggaggcgtcattgtcaggaaaccctttgatgtttttcacacttcccaatccttaaaagaactatcaaattatctggcttcacttgaaggggatacaaggattgtaatggagtgtactggcagataccatgagtccatggctaactccctctctaatgccgggttttttgtaactgtcgtcaatccgcatctgattaaaaactttggtaacaatacgttgcgcaaggtcaaatctgaccctgctgatgctaaaaagatagcacgctatacccttgacaactgggctgaactgcggcagtattcatgtatggacaatacacgtaaccaattgaaaaccttaaattcacaattcagcttctttatgaagcaaaaggttgccgcaaaggcaaacctgattgcactgttggataatacataccccggtgtaaataaactgttcaacagccctgcccgtgaagatggcagtgaaaaatgggtcgattacgcttactcattctggcatgtggactgtgtccgtaaaaccggcttgaaagcttttacagtgcgctatgaagctttctgcaggaaacaccattatatttatcagccttccaaaccagaagaactgtttaacgcctctaaagagcttgttgccgtgttcccaaaggagacgtcctataagcttctgatccagcagagtatccagcagctcaatcttgcctctgcccatatcgaacagctccgcagggagatgaatgcacttgcttccacgctcccagaatacgaggttgtcatgggcatgtatggcgtgggcaaaacttacggtccccagctcattgctgagattggcgatgtttcaagatttacccatcgggaggcaatcactgcttttgcaggtgtcgatcccggtgtggagcagtcagggcagcacaactcaaagagcaacaaagcttccaaatgtggaaccggcaggctccgtaagaccctgttccaggtcatgaccaccctgctccagaatgccccggagaatgaacctgtctaccagtttctgaaccggaagcgttccgaaggaaaaccttactatgtgtacatgactgctggtgcgaataagttcctccgcatctactacggcaaggtaaaagcacatctgcgcagtctggaacaaaacgaataatcattccgtctattacggctttctttttgaccggctgatgaggcggtcttagagttgtgccataaaatcacttcacaaaaattttcaaaaagtgcttgactttttattagcaggctttcttacataggaaaatatagttatatataatctttcgttacttcatttttgtttctgttttaccagatttttattaagtttatcatagtctccaaagcgtcgaaaaagcgtcaaaacctgtaaagatagtgataagaaaatggcaggcggaatgctgttgcagttcacacgtttttcggttgacatttttttaagtcaggaatagaataaaaacagacataaagttagctatctaacagtgataatgctaataatttatgcgatgcagtacaaggagagtgaggagaagaacttatgaaagtatcattttacatgctgctgtaccgggcctttcacgcccagaggaagtgcctgaggcccttcatggcggaacttggcctggccccgggccagccgaaggtgctgctgtacctggccggccacgacggctgtatgcagaaggacgtcgcggagcactgtgacattgagccggccacaacaagccgcgtgctggatacattggaaaaaaacggttttattgtccgcaagacgatggagggaaaccgccgcgcaggcagtatcctgataacggagaaaggacgggaagttgtggaaaagtgggtagggcactgtcacgaggtggaggcttccatgctgaccggatttacggaggaggagacggcgcagtttggcgattttttgagccgggcttataaaaatatgagtggtaaagaagcaagatagcagaacgttactattcacagccccgcagaaaaacacgttttctgtgaaccgtaacagctaaacagcaactcagtggaggcataagagtcatgaaggatttaaaaaggattttaaagtttactagaccataccggttagatttctcgctggcaattttctttgtcgtgattgaaaccagctttgaactgatcatcccaatgatcatggccggaatcttggacgtgggcgttgccggccgggatttgaactacattttttccagaggcggtctgatggcagcttgttcgatcatttcactaggcaccggccttttgtatgccaggtactccgcccgggcggcaggagggtttggcgcggggctgcgtgaggcggagtatgaaaaactccaggaatattccttcgggaatctggatcattttgagacctcttccatgatcacacgactcacaacagatgtgaccgtaatgcagaatgcaattgtcggaggaatgaggccgataatccgaggcccggtcatgatggtattggggcttatcatggcctgctatatgaatgcgcggctggcgctcgtatttgccgtctgcatgcctgtgctggcggcaattctgattgtgattatcagcagagtggcgccgatgtacggtaggctgcagaaggcggttgatcgtgtcaatggagtggttcaggagaacctgacggcaatccgcgtcgtaaaggcgttcgtcaggggggagtacgaggaggaaaaatttgcggaggtaaataataatctgaagagaactagcgagagaaccttccattttgccgttctcaatatgccgtcctttcttttgaccatgtatgcggcaattatactgattctgtggtttgggggacagatgattcaaacaggaggaatgcaggtcggtgagctgacgggattcctgagctatgttatgcagattatgaattccctgacgatgatatccaatgtatttctgatgctgacccgctctctggccagcgcaaagagaattggcgaggtttttgatgaaccgctggatttaatggacgggagcgagccggaagccaaaatcgaacacggaaccatcgattttgagcatgtctcatttaaatataagaaggaagcaaagcgcaatgtcctaaatgacatcaatatacacattgaaaaggggcagacggttggaattatcgggggaaccggttccgccaaaagcactcttgtctctctgataccgcgcctctatgatgtcacagagggaagcgtgaaagtggacgggcgggatgtgcgtgaatactcccttacacacctgcgcgatgccataggtattgtactccagaagaatgttcttttttcaggtacaatccgggagaatttgaaatggggcaatctgaatgcagatgagaaggaaatcgagtgggcctgccgggcggcctgtgtggatgagttcatcggacgttttccggagggatatgatacggatctgggacagggaggagtcaacgtatccggcggacaaaagcagagactctgcatcgccagggcgcttcttaagaggccgaaagtcctgatatttgatgattccaccagcgctgtggacacggccacggatgcaaagatcagaaagcatctggccggcctcgccgacacgacgaaaatcattatagcccagagaattacgtccgttatggattccgaccagattattattcttgaagatggagagatacatgcggccgggacccacaaaagcctcctcgaatcggatccgatttatcaggagctttattattcccagcagaaaggagctgatgaagatggcaagacagtttagcgccaagaggcctgaaaacctgaaaggcacaatatgcaagcttctcggatatatgggtaaccataaattcctgtttcttctggttgccctgctgacgacggtcagcgcatcggccggtctgtacggcacctatatgctgaaaccgattgtcaatgattatattgtgccggggaatatgagaggacttttttatgccgttcttgtaatgggagctgtctatctggccggtgtattatcttcattcggatatacgcagcttatggtaatggcagcgcagaaaattactgcggaaatcaggaaggatttattctgtcatattcagaagctgccccttaaatattttgataccagaacccatggcgatattatgagccgttttacgaacgatgtggatacggtttcagatgcgcttaacaacagttttgcaatggtaatccagagctttattcagatagtcggcacgctcaccttgattttcatcctgaactggcgcctgtcactgattgtatttgcctgctacattctgatgtttgcctatatccggtacagcggacaaaagagcaaatattatttcaatttccagcagaaatacctgggcgagctgaacggttacattgaagagatgacagccggacagaaggtagtaaaagtattcaaccatgagaaagagaatattgaacggtttaataagaagaacagacagttaaagcaggcggctgtcagcgctctgacctactccggcactatggttccgatggttgtcagcatctcttatgtcaactatacgatcgtgacgatggtaggcgcatttatggccttgaaaggctggaccgatattggaagtctcgcaagctatcttgtctttgtaaggcagacggcgatgccgatcaaccagtttacgctgcagtcaaactttcttctggcggccctggccggagcggagagaatcttcgagactatggaggaggaaccggaggcggatgaaggccgtgtcacactcgtgaatgtaataagagcggaggacggtccgctcacagaatgcccggagaagacagggagctgggcctggaaaaccgaggatgggggattgattccgctcagaggcgacgtacaatttaaaaatgtggatttcggctatgaaaagggccggctgatattgaaaaatatcagtctctacgcaaagcctggacagaagattgctttcgtcggcgcaaccggagccggtaagacaacgattaccaatctgatcaaccgcttttatgatatcgacggaggaagcctgacctatgacgggattgacgtcagggatatcggaaaggatgcgcttcgttcctcactgggaatcgttcttcaggatacgcacctgtttaccggtacgattgcagataatatccggtatggcaaactggatgccacgatggaggaagtggaagaggcggcaaagctggcaaatgcagattcctttatcggaaggctgccaaaggggtacgagacaatggttacatccgatggaagcaacctttcccaggggcagagacagcttctcgccatcgccagggcagccgtcgccgatccgcccgttctgattctcgatgaagcgaccagttcgattgacacgagaacggaacgtctcatcgaaaaggggatggaccggctgatggaagggaggacggtatttgtgatcgcccaccggctttccacggtgcgaaattccaacgccatcatggtactcgatcagggcgagattatagagagaggcgatcatgaggatctgctggcccagaagggagtgtattaccggctttataatggaatgtttgagctggcatagaatagcatattacgaggaaacggcagaaaaattgccgtttcctataaataagtttatagctgatacaaaaggctatgaactttttttgttggtgacgaatggtgctacagcaattctaaattattccgtaaggaaattgacaggaagcactattgaatccggccgcggatgggtttataatatcaatatacgatatcgatacttgatattgagtgttgatatcaaaaatgccgaaacggtatgaaaggatgcttaattatggcgaaaagaacgctagaaatattgacggaatccatgttttacgtgctgatgtcattcatggggaaagagatgtgcggcatcgagattgccgaatttgtagagaggaagacaaagggcagggtcaggcttggccccggtacgctgtatacaattttaggtaagtttgaagaggaacattttatagaagaaattcaggttgaaggcaggaaaagaacctaccggatcacggaaaagggaatacaggcataccgcgatgaggtgacgcggctcagaatgtgtatcgctgatgcggaaagtgagggatatctatgaataaagagattatgaaacggctgccttttgcggagacgaatgtggagggaatcgagctgtggctggatcagatggccctggaaggcctcttcctgtgcgatacggcaggaacatcctggtatttcagggaaggagagcctgaagctatccggtacagacttgacaaagtgacggaaaagggggcaatgcccagtgtggagaagagggaaagctatcagaagaagggctggaagtatctgcttacacacaagacaatgtaccatatctttcaggcaaaggacccgcaggcagaagaactgcacatggacggacttgaggaaagccttaagcttaagcagttacagacaacattccggtcgaatctgatactctgcatagcatctgccgccgccgggtactggctttaccggatgaccggatatgtattttttcagtatcctctcttatccatcgtatcgccggattttaaccgtatctttctggccgtatggctggcaggctgtgtcttgagctgtatcttttcctataaagatgtcagggcgatgagacggtatatggcagagggaagaaaagcagggtatgaaaaggaactgacggggcggagcctgaaagagaagctgtcccggtatttttttccaatctggtttttcctgtatttcggcgcttgcattttattccggccggagagtgtggagctggacggaaggatgaatttcgaggggctgccggttctggaggcatttgaagacgggacggtagagacaagcgacggatggtttctcaatggtcagggagaccggtatatcgaatataaaaatctgctgctgaatgagaactatgaactccatgagacccggatggtgacgaaggaaggccaggccgaaagccgtgaaacctccatttccgcctactatttcgacagcaggatttcggctttgacagagccgttatttaaggaactggtaagaaaatatacgggagccgaaaacagtgatttggctcagtcagcgtcttcaggtaccggtcttgatcattgcgtctatgtaaaagagggggagaaacaggtggtggcggcggcagaggggaaccggatcctggttgtggagtacgacggacagagcgatatgaaggagaaaaccgggataataaaggaaattctggaaaagggaaagtgaggtgtattctgtgaataatgaaagatataaatatcctcccgtcgatgcattggacataaaggagatcgaagtctggctggaagagatggccggccgcggattgttcttgaaagaggccgggccgtatgcatggctttttgcggaagaagaaccgaaaaccgtgcggtaccggattgagcccgccgccgggaaaaaaggaaaactggatgccgatcggcaggcggactatgaagctatgggatggcattatgtggcaaaatataatacatattatcatatttttatggcggatcatccggagacggaggaacttcatacggatcggatagtggagagcttttctcttaaaatgctggaaaaaaagatcaggaaggatttagtttttctggctgtgctttgggcattcattgcagttgactcttttttctcgtccacccattttctgcggtatccggtcctctcattcattgaactccggcctgcggtaatcctgtacagactgtttatggccgcctggttttttaaaacgcttttcctcgtcttaaaagtgcataaactcaggaaaatgctggcggaaggaataccggtgaaggtaaaaaaggtatccggaaaacggatcaggaagaaaagaatcggacatactctggaacggattggcattggctttctgatagccggtctggtcctgtcattttttccggagcgtatgggagaaccgcttgagcaggcaatgacagccgggcgctttcttaccctggagcttctcgaagagagaggaggagaggaaggggcaggctgggcagcaaaggagacagaagaggagggggaaagcggaggcaccgtatggcagcgttttaatatactgacagccgggaattacgaattatatgagagggatgcggataagaagacggatgcgccggcctcgtcactgcatgtacagtatttcaggatgcgctttccctgtctgaccggagccttgttttcagaggtgcaaagaaaatatatcagcggcacattgacggcaggggatcctttgacggcggaaaatgctctgggagcctttaccatagtttacggcatcggggaggatgggacacaggctgcggcggccaggcaggaagatgatgtgatattgattgagtacagcggcccggagatgcttaaagaaaaaacagagttgataggtgagcttctggtttcagagaggaggcggagatattgaagaaagaacgtatacgcaggattccggtgaatgatatggatataaaggccgtggaaaggtggctgaacgacatggcggcccgtggccttttcctgagcagtacaggcagtagctggtggcgcttctatgaggacgagccggaagaggtgcgctaccggctggaaccggtcgaggagagggacgggaaactggatcacctgaagaatgaggattatgagaaaatgggatggaagtatgtggcgagccacaaggactggtatcacatctatctggcccaatcggggacggcagaggaacttcatacagacccttttgtcaagagtatgctttttcagaaatatcaaaaatcactctggtcgattgcactcagtgatatgatcatcttaggcgtcctgataatgggcatttaccgtctgttcagcacagaggtatccggaccggctttattcctggcaagccctctgtttctgcagaatgcggtggtcgggacgctgcttcttatcatgccgcttcgaacggctgccgccatttataaggtttggaaattgagaaaagatctggaaaatggaaaaagcggggaagatggggcggaagcgctatgcaggatacgctacagctcccgggccggttatgcagtgacctttttgattgctgcttccatcctgactgtcttcacgggcgtcggaacaggaggcccgattgaacaggagataagggagcgccaactgccggtcctgcaggagctggagacaggcggggtgacggcagcacccggtgaaaatgatacgggtaatgttatctactttttcaatccttttttgaaagagcggtatgagataagacaacaggggtatgtggaaagagaggggaaaaactcggaaaacaaagacaagctttcatttttgaaggcagatttgtatgacgcgcgtttcacctggctctccgaggcactgtgccgtgaactggtggaggaacacctgtctcaccacggcggcggatacagggaacttgcgaaagaggggtatgacagcttttcactactggaagatgggaaaagccagattctggtggcaagacggggaaagaaggtgctggtactttattatcagggaagagaaaaactggaggataaagcaggggtactcgggacgattctggaatcgtgaataaacaggcaggcataaaaaggcggaaaactgccgggaatatacattctatatgtataaaatgctatatttatgcatattaaaaatgaatatacaatatatatacaatatttttaataaaaattcaaaaaaggtattgcataattattctcatagaggtataattatgccaatttcacagcagcccattgaacgttgctaatcacagcgcgaaacggtgtttttaaaaaagcaaacaaaatggaggagaactattatggaaaagaaatacaacaaaatcgtacttgcatattcaggaggacttgatacatccgttttaatcccgtggttaaaagagaattacggctgcgaggtggtggccgtatccgccgatgtgggccagggcgcggagcttatcggacttgaggagaaggcgcttaagacaggcgcttccaaactttacatagaagatttgaagaaagaatttgtggatgaatatattattcccacgatgaaggcgggagccgcatacgagcattacctgctgggaacctccttcgcgcgtcccattatagcaaaacggattgtagagattgcgaaaaaagagggggccgacgccatctgccatggctgtacaggaaaaggaaatgatcaggtccgtttcgagctggcaatcaaagcgtttgcgccttcgatggatgtaatcgcgccatggcggttctgggagcttaactcccgtgagaaagagatagaatatgccgagcagcggggcattccgttaaaaatcacaaaagagaccaactattcaaaagataaaaatctctggcatctctcccacgagggactggatctggaggatccggccaacgaagcgccgcttggcaaacccggatttttagagctttctgtttcaccggagcaggcgcctgatacaccagcctatgtggagattcattttgaaaaaggcattcctacctccgtcaacggcgaggagatggattgtgaaaaggtaatcgaagttctgaataaactgggcggagagaacggctgcggaatcctcgatctcgtagaaaaccgtcttgtgggcatgaagagccgcggagtttatgagactccgggcggaacgattctctataaagcccatgaaaaactggaagaaatcactttggacaaagagacacagcactacaaacagcagcttgccctgaaatttgccgacttagtatacaacgggcagtggtatacccctcttcgcaaagcgatgagcgcttttgtggattccacacaggagacggtgaccggcgatgtgaagttaaagctctataagggaaatattattccggcctccgtaacgtcgccgtactccctctattctgcagatatggctacctttgacgaggatgactgctatgaccaggccgattctgccggtttcatcaacctcttcggccttccaatcaaggtgcgtgcgttaaatgaccaggcactggctgcgaagacagggaaacattttccggaagtggagtaatcgtaacagttcatgctgtctgaactgttacaagtaatcagagtgccgaacatttttaatgataaggagtaatagagacaatggctaaattatgggcaggacgtttcgggaaagagacggatctggaagttaatgattttaattcctccatttcgtttgactgccgtctttataaagaagacatcaccggctccatggcccatgcggccatgctggggaagcagggaattatcgcggaggaagaggctgacaagataatagaaggcctgaaagggatattaaaagaaatagaggcaggaaaaattcagttttccgcggaatatgaagatatccatatggccatggaacagattttgacggaacggattggggttgcgggaaagcgtctccataccgcaaggtcccggaatgatcaggtagctcttgatatgcgcctttatgtgaaaaaggaaatcggcgagataaagaaactggtcatcggcttcatggaggagctctgcgacagttcgaagaaaaatcttgatacggtgatgccgggctatacccatcttcagagggcgcagccggtgaccttcggccactatatgatggcttacgccaatatgatgaaacgcgatgtcatccggcttgacaactgccttgagggaatggacgacatgccgcttggctcgggtgccctggcgtccacaacttatccgattgaccgtgattttgtcagggagcagcttggatttgccagagtgacggataattccctggacggggtatccgacagggattactgtgtggagctttgttcggcgctctccatcctgatgatgcatctgtcacgtttttcggaggaaatcattgcatggtgttcctgggagttcaaatttgtggaactggatgatgcattttccaccggctcctccatcatgccgcagaagaagaacccggatgtctgtgaactggtgagaggaaagacagggcgtgtatacggttccctctttacgctgcttacagtgctgaagggaatcccgttagcttataataaagatatgcaggaagacaaagaagcagtatttgatgccatagatacggtaaaacagtgtctgagagtgctgaccccgatgtttgccacgatggagctgtgccgggagaatatgaaaaaagcggcgcttaaaggatttatcaacgcgacggactgcgccgattatctgaccaaaaagggaatgcctttcagggacgcgtataaaacagtggggcagctggtagcggaatgtgtaaagcaggataaatccctgatggatctgacgcttgatgaataccgtgagcattccggactttttgatgaagacatttatgatgcaattgacctcaaaacctgcgtcagaggccggaatgtaaccggaggcccgtccccggaggaagtgtcgaggcagattgccgtgattgagcggttcattgtaacggttcagacagcatgaggaaggaagaaccacagatggcgaaaccgaaagtttatatagacggaaaagaaggtacgaccggacttcagatttatgacaggctggccggacgaagcgatattgagcttctgctgattgaggaagaaaaaagaaaagatacacccgaacgcaaaaaactgattaatgaggcggatatcgtttttctctgtctgccggatgaggcagcgatccatgcggcagcgctggctgaaaacccggccacacggattatcgacgcctcaactgcccacagaacggcagaaggatgggcttatgggatgccggagctttcaaaggagcatcggaggctggtggagacgtcaaaacgggtagccaatcccggctgccatgcgaccggctttataacggcggtctatccgctggcagcgtcggggattctgtctcgcgactatccgctgaccgtgttttcactgaccggctattcaggcggaggcaagaagatgatagcggagtatgaggcagccgaaaagccgccgctttatgataccccgcggatctatggcctgaatctgaggcataagcacctccctgaaatgcagaaaatctgcagacttcagtatccgccggtattcatccccgtggtggacgattactataagggaatggcagtgacggtgatgctgcaaaacaggctgctaaatggaaagcaatcggcagaagagattcatcaggctctgaccttgcactatgcgggcaggaagctggtaaaagtccatccctttggctatgacaaaatgatagctgccggaaccatggccgggaaggacagtctggaactgattgtaaacggacacagtgatcagaccattatcacggctctgtttgataacctgggaaaaggcgcatcaggggcggcagtgcagaatatgaacctgatgcttggatttgaggagacgcagggactgaacctgtgatacacgaaaacacctcgcgggacgttaccgtatgagcagtaactgtgacattgcaacattatgaaaaaggaggaactttggagatgaaaatcatagatggcggagtttgtgctgcaaagggctttaaagcgggtgcaatacgctgcggaatcagaaaatcccagacaaagaaagacctggcaatgattctttcggactgtgaatgcagcgcggctgccgtatatacgacaaacagggtgaaagcggccccgatacttttaacgatggataacctttcaaacggaaaggccagggcggtgatcgtcaattccggcaatgccaacgcctgcgccccctttgggattgagaatgccagaagagaggcaatggctgcggcccgtgcgctccatgtcgcgatggaggatgtggttgtggcgtccaccggcgtaatcggccagactctcagcgtggagtgcatcgaagaacatgccggaagcatggaaatgaaatacggaaactctatggctgccgcagaggccattatgacaaccgacacaaaagtaaaaacgattgcggtggaatttgaggcggacggtaagacctgccatatcggaggaatctgcaaaggttccggaatgattcatcccaatatgggaaccatgctgtcctttatcacgacggactgcgccatttcgtcggaaatgcttgataaagcgcttaaagcggatgtaaaaaagacgttcaaccgtgtgacggtggatggtgatacgtccacaaatgatatgtgctgtatcctggcaaacggcatggcgggaaacctcccggtggagcaggaagggccggattatgacgcattttgtgcagcgctgcatatggtgacggaagatttggcccgcaagatagcggcagacggagagggagccagcaagctgatgacctgtacggtatcaggcgccctggacgaggatacagccgagcagctctgcaaatctatctgttcctcatcccttgtcaaggccgcaatctttggttccgacgccaactggggccgcgtgctttgtgcaatgggctattcaggcgcagcattcaatacggaagaggtgacagtggaatttgcctctaaagcaggtacggtcacggtctgtgagaaagggcgcggcctggatttcaatgaggagctggcgaaagagatattagatcaggaagaggttgaaattaacgtaaccctgcaggaaggcagcggcaatgtcacgtgctggggctgcgacctgacttatgactatgtgaaaataaacggagattatcggacatgatgaatttaacccctgagacgagggccggaatactggtggaagcgctgccgtatatccaggaatatgccggccagattatcgtggtaaagtacggcggcaatgcaatggtgagcgaaatgctcaaagaagcggtcattcaggacattgttcttctgaatctggtaggcatcaaggtcgtccttgtgcatggcggcggcccggagatatcggaaatgctgaaaaaaatcggcaaagaatcgacctttgtcaaaggtctgcgctatacggacgaggagacgatggatatcgtccagatgattctctgcggcaaagtaaataaaaatcttgtctcccttctggagaaagcaggcggcaggggcgtcggtctcggcgggatggacggtggcctcttcaaggctgtcaggctcagggatccggatggaacggattatgggtacgtcggcgagattaccgaggtaaatgaaaaactggtgctggatatgctggaggagggattcatcccggtggtatcctccgtggcggccggtgtcgatgaggagacaaattataatatcaacgcagatacggcggctgagaagctggcggtggctttaaaggcaaagaaactgattctcttaaccgacgtgcgaggactgatgaaggtaccgggggacgacagcactctgattccaaaactgaaggtatcggaggttccggctctcgttaaatcgggcatcatctcgggcggcatgattccgaaagtggactgctgtgtggaggcggtacgccagggggttgagagggccaatatacaggacggccgcgttccccactcgattctgattgagctgctcagcaaggacggcgtgggaacgatgttctcataagcaggaggaaaatatgacatatcaggaattgaaagacgaagaacaactttatttaatgcatacatatggccgctttccggctgcgctcgaccatgggaagggagccactctctgggatatcgacgggaaaaagtatattgatctgacgtcgggaatcggagtaagcagcctgggccacgacaacgaggcccttgtatcggcgctgaatgaacaggcccataagctgttgcacgcatccaatctgtatctgacggagccgatggtgcaggtggcaaaagagcttgtaacctcctgcggcatgggaaaaatatttttctccaactccggcgcggaggccaatgaagggatgattaagctggcccggaaatattcctatgacaaatatggggaaggcagaaataagatcatcacgttaaagcagtcgttccacggccgtaccgtcaccacgcttaaagcaaccggacaggagaaattccatcagtatttctatccgttcaccgaagggtttgattatgctgcggccaatgatatcgaagagcttaaagataaggccgatgattctgtctgtgccgtgatgatagaactgatccagggtgagggcggcgtcctgccgctggataaagaatatgtgcagcaggcggctgagttttgcagagcgaaggacattcttttcctgatagacgaggttcagacaggaatcggccgtaccggcagtctgttctgctatgagcagtacggagtaaagccggatgtcgtcagtatggctaagggccttggcggcggcgtaccggtcggcgcggttatggcatcagagatatgcgcggatgtgctgggggcaggcactcacggaacgacattcggcggcaatccattctgctgcgcagcggcccgcaccgtgctgtcggttgtcaataaaccggagttcttaaaagaagtgcagcgaaagggcgaatatttgaaaaacgccattctggcaatcggctccgacaagattaaaacggtcagaggcatgggactgatgctgggaatcgtcgtagataaagaaagccgtacaggaatggtcaaccgtttgcttgaaaagggcgtcctggcgcttactgcaggggaagagacaatccgtctccttccgcctctggttatcagctatgaagagatggacagcgccgttgccgttatgaaggaggttttctgaaaatgaagcatttattaaaactgctggactgcaaacaagaggaaatcacagcgattctggatctggcggatcagctcaaatatgagagaaagcataatattacacaccggcttctggagggaaaatcgattggcctgattttccagaaatcctccaccagaacaagggtttcatttgaaacaggaattttccagctgggcggccaggctctgtttttatcgtcaagggatcttcagattggccgcggcgaaccggttcaggatacggcccgggttctctcgcggtatctggacggaattatgatacggacctatgagcagaaggaagtggaggaccttgccagatacggccggatcccgattataaacggtctgaccgatttctgtcatccatgccaggtactggcggatttgatgacaatcagggaaaaatacggggttctaaacggcctgaagctgtgctatatcggtgatggaaataacatggccaactctctgattgtgggcggactgaagatggatatgaatgtgtcggttgcgacaccggaaggctaccggccggataaaacagttcttaactttgcttccgaatacggtgaagcattcacattgacggatgacccaatgaaggcggcggaaaatgccgatatcgtggtaacggacacctgggcgtccatgggacaggaagaggagaaaacagtccgtatgaaggccttccaggggtatcagttaaatgacaagctgatggccgccgcgaaacccggagccatggtgcagcactgtctgcccgcataccggggccaggaaatcacggataagctctttgaagagcatgcggatgagatatttgaagaggcggagaaccggctgcatgcgcagaaggcggttatggttacgttgatgaaatagaaacgaatatgaaaaacgacttagataatagtttgggggaaactgccaaagaatatctgagccgtttttattttatcctggtatgacccgcatcaaacctcagtctttccgccgataaatcgctgagtgtttggactgaatgctgcaacaattcatgcttataagctggatgaaataatagcaggcttctaccgttgctataaaggatcatcatgtgttaaactagataaatacataaatataaatctggtgaggataaaatgattgatacaattttagaactgctaagctacatagatgctccggaaatgaaaaagtttatccttattcttctgctgtaccttttggcggtaatcggtgcagggaaactgtttcattcctacctggtaattaaatatataagaaactcattcattgctgtgttgggagccgtcatagtcattacggccgacattttatttatagaaccgtccaccggtaaatattgggcatttttatggggagccggtgcagtctgcctgctttcagcttctattttattcataagatacaagcattactgccatattctcaaagtgatgaaaaaaacagaatcagaggatattatttctgcatggaagaaattaaatgaaattccgctttcgaacctgactcccggaataaagaagaaatatttggagcgctgcctcttcgtcttgttacttttgggagatctggaaaaagcggaaagatatctttcacagttgggggtcacggacggtccgttgttttactttttccacggttttaagcaaatgtctgcaggtgacatagtccgggcgggtgagtcaatgatgaaggcggaaaaatgctgtcagcaaaatacgcctccccaactgtacattcagattctcaataaccggggagtgctttacgtatgccagggaaattatcaggaggcagattactacttcaaacaggcgattgcggcggccggacaaaacaagaaaatgaatatggagattctggaaccggtttattataattattgttttaatttgtgcagaattcgcgaggacatgaaacggggagactggaaaaaaatattggaggaataccgtgatttactggatatggggaaggcgaaagcttttatttccgtatgcaatattgaattggagctgctccgccagacagaggaaaatacacaggagactgaaaaatggatccagggacaatttttacagacactgaagtatggactaacggaacaggaaagatgtgtttacgagggcagtatggcaaggatcgtctgctcgatgcgttttaatccaaccaactgtcttgaagcgcttgagaaagacagagagaagctctcaggacttcccatgccggcgcgataccgtacatggaaggagattgatttgctgtttcgtgatttgtacgatgacagacttttgggacagtatcatgatttggatagggcggcggaaaactatatggcgtttcaggcggaaaaagagatccagaactatatcgactccctaccggcagaagccgtatatgaacggtgccattaccgcaaagaattggccgggatgaaaagaatgcatattgaggaataccggtttgagaaggtgaaacaaatgctggaggatattacggccgtttatgaggaaaaccatttggaaatcgatgcgcttgatacgcgtatggctatcctggacgaaggtacgtttgccttaaacctgacagaacatcataagcccatctatgctgcagagatgcagaatcagatgcagcttgtagaagctaaattagagaaaatgatccagcacccaaaaacagcagaatatgcgctccgcctttgtttctactgctgtcatctggacgaatatcagaaatgcctcatgtattttaaacggtttgaggaagtcggactttccctgagccactttgctccatggctgagaaactattactcattttgttctgtggttatccggattttaaaatttgcagatgcgattgaacaagtccggagagaacggtcaaaactggaaatatacgaagaggctgtccagaactggtttgagcagtttccgttttccgatgggttccatgcatcgctgctgctggggcgttttatgggatgtaaaaccatacgggttaaatataaaatctggtatcaggacaatgaaatcgacagagaggggagacgtgattttctggattcaaagaatgaagacagacttaaagcccatgtttggtactgtgaagagagcatccacatggaggccgatttgacgtatcgccagttttcttcggatgaaaagtcggattttattttattttcagagactcatcatccttttgaggtgaatgaatcctgtcatctgttaaaacaggccaggatgagccggatgaattttctggggatacaggaaaaatatatagagataaaaaatcttccaaaagacgttcaggaattattagatatcgtatataatattattatgagcaaaataaccgattaatgacagtacagtaaaagagagggtggtgtgatgaaaatcaggagaacaattcttgcgttgctgctctatgcggggtttctgtttttctctgtttacgtggctttggggaatgacatttgggacagactgcaaaagtggaggaaacgggggaccaattagctgattgaacagaaccccagttacaacttcacaacagcagaagaattcaggcataattccacgcggattgcaaatactgataaatcagagtaaatatggatatatctgatttccatccacatatgcaactgctgatcaatcatccggaaggagtaatctgctgatatgactgaaaagaagctgaaaaaatccaaaacagacacagaaccccagtacatgaaagatagtgcaaagggcacagagataaccccacaaactaatttaaaccctaactgtccctgcaagagagactgtatccgccacgggaactgtaacgagtgcagagcggtacacgaagcagaaggtaagtatcctacctgctgccagaggattgcggacagaaagaagagacaaaagaaaggaagcgcatagcatggatttcggacaagccgcagaactggttgaagcgttaaggtcgaaagacgaaacaaaggcttatcaatgttttaagttactggagaaggaatcatccgatacggatcatgtataccccttctttgacctttttgcagatatgatagaagatgaaaattcctatgtcagaacgagggggcttctgctgattgccgccaatgcccgttgggacacggagaataagattgatgagctgatagacagctatctgaagcatattgaggatgttaagcctatcacatcgagacagtgtatcaaagccctgccgtcaattgtcaagtataagcctgacctttatgattgtatttgcaccgcgctggaacaggccaatccgggcatttacagggacagtatgagctctctggtaatgagagatattgccgaggcgctggcgtctatccggagagaggggcgatgagatggttcttaaaacagacaggctgatactgagaaacatggggcaggaggattacgaagcgctttgccggatattaaaggacaatgatgtgatgtatgcctacgaaggagctttcagcgatagagaagtacaggaatggctggacaggcagacagagaggtatcatcaatatggattcggactctgggccgttactttgaaggacagcggccgtatgataggtcaatgcggccttacgatgcaggattacagggaaaaacaggtgcttgaagtcggctatctctttgaaaaagcatactggcatcatgggtatgccgttgaagctgccgccgcatgccgggactacgcctttaatcagctagatgcagaagaagtctattccatcatcagggacagcaataccgcttcccagaaggtggcacagagaaacggtatgaggtacagggatacgattgttaagcactataaaggtgttacgatgccgcatcatgtatattccgtaaagcggaaaacagagtcgatcagcctgtgcggagttgactgcacggattgtgagtatttcgggacagaggaggacaggtgtgccggctgtgatgagatacagggcaagccgttctggcttaaatatacaggggaagaaatctgcaggatttatgaatgctgtacatataaaaagaaactgccccattgcggaaaatgccgccggctgccgtgtcctctctatgaaagcagcgatccgaccaaatcggcagaggagaatgaggcaatctttctcagacagatggaacagcttaagaacaggccatgaactataaaacgatgacagagaatagggatccggcggttggccggatcccgtttgcgcgtctgtcaatgaatcattattggaacaggccgtatctcacagataaacggatttatggtttctgctaaaatagtaccagcctgtaaaaagttgtaaaagcacttaagtctcccggagcgcataagatagattaacgtagctttgaggtggctttctttgaaaacatttccaaaaccattgacggccagtgaagaacgtgagtatctaaaacgctgcaaagagggagacgaagaagccaaggccgttttgattgaacgtaacttaaggctggtggcccatgtcataaaaaagtatcaatatactgattatgagatggaagaccttctgtcggttgggacaatcgggctgatcaaagccgtgaatacgtttaagatggaccgcggctccagactggctacttacgcagcgaaatgtgtggaaaacgagattctgatgctgtttcgcgccggtaaaaagcattccaaagatgtctccttatatgaccccataggagttgataaggatggagagaccgttaacctgatcgatgtgatcgaagcggatgataaagctgccctggagacgattatattggagcaggatgtctctgaactctatgatgcctatcggaaatgtctgaaaaacacggagcaggaggtactgagcatgcggtacggactctttggggagcaggaacgcactcagagagagatagccggtaaaatgggaatctcacgttcttatgtcagccgtattgagaagaaggccctggaaaaactgaggctggaatttgagaagaatgggtgaaccggaaattttgaatgtcggggacgatttgcgtctgtcagcaaaccggtttctgcaaaatatgcagaaggccggttgccgaaccggccgcctggaaaaagacagcataaattcgataatttatcgcaatatttctgattgtattataaatatcctccgtatataatgaaagctgagcttgaagttttgattgatggcagtgaaaagtttgcggaacgcgtttttcattgcgagaaggaggatgttgattatggcaattttagttacaggcggtgcaggctacataggaagccatacgtgtgtagaacttctgaacgcaggatatgaggttgtagtggtggataatctcagtaattccagcgaggaatccttaagacgtgtagaaaaaatcacagggaaacaggtgaaattctatgaggctgatttattggataagcctgccatagaggctgtattcgataaggagaacattgattccgtgattcattttgcaggactgaaggcggtgggtgagtctgttcaaaagccactggaatattatcataataacattaccggaacgctgctcctctgcgatgttatgaggaaccatggcgttaagaatatcgtattcagttcctcggctactgtttacggagatccggcattcgtaccgattacggaagagtgtccgaagggaaagataacgaacccatacggacagacgaagagcatgcttgagcagattctgacggacctgcatgtggccgatccggaatggaacgttgttctgctgcgctatttcaatccaatcggagctcataagagcggattaatcggcgaggatccaaaggggattccgaacaatcttgtcccgtatattgcgcaggtcgcagtaggcaagctgaaatgcctcggagtttttggggatgactatcctacacccgacggtaccggagtgcgtgactatatccatgtagtggatttagcggtaggccatgtcaaagccctgaagaagatagaagagaaggcaggggttaccatctacaatctgggaacagggaacggctacagtgtccttgacgtggtaaaagcttatgcaaaagccagcggcagagagattgcttatgagattaagccgagacgcgccggggatatcgcaacctgctatgcagacgcaactaaggcgaaagaggaacttggctgggaggcagagcgcggcatagaggaaatgtgcgaagactcctggagatggcagtcgatgaatccggacggttacagaaactgagacagaaaccggcaaggcaataaggaaggcaaagcggcttttaggcgtgcgccggattagcagataactgaaaataaatttatttactgtccggccttagccggacagtatttttatttgaagacggtggtctgtacgcagagcgtgcaggctatcgtttaacaggaaagttctcctgttaaataaaaaccgctccgcggaggatcgcaactctaaagagggcttgttcactaagctcgttacactcgctaagtgagccaatgcctgcgacggcagggaataatgtcgctgaagcgacccgccgcagacagaaaaaggctcccatacgttcataaataataaatagatttgccgaaaatccggattttgaagctctttgcggtcattgcagaatctgcggttgtaattcgttgataaagttgttataattattggctgaactataaaaatagttcggaaaaggatagggaggatttttgaggtgaaaaaattgactgctttctgcgggagcctggcactgatgctgtttttcagtccgatgacggctctggcagcagaacatgtggccggcagtgagaaaacagccgtaccaatctggctgtgtatcccttttgccggacttcttttgtgtattgcggtgctgccgctgattaaggccgagtggtgggaagagcatcagccgcatgcggtgattttctggtcattgctttttattgttccattcgctctttcatttagtgcagggactgcattagagaccgttctggaatgcatcgtgaacgattatctgacatttataatcctgcttttcggcctgttctgtgtttccggcaacattacgatgtccggggacctggcaggctcgcccagggtaaacgtggggctgctggctctgggaacgctgctttcaagctggataggcaccaccggcgcaagcatgctgatgatccgccccgtcatcaagatgaattcatggagaaaaaggaaacgccacattattgtgttttttatttttctggtttccaacataggcggctgtctcaccccgattggggatccgcccctgctgatgggctttatgagaggtgtcccctttttctggagtttgaagctttttccgcttcttatctttaatatggcagtgctgctgttcctgttttactggctggacaggcgtgcataccgcaaggatattgccctcggcctgaaaccggatatcagtaagcccggtacggaggttaagatcaggggagcgcataatctgatttttctgattatgattgtggcagcagttattttgagcggtaccctgccgggacatccggcgtttcaggatgcggcgggaaatgtgaagggaattcatatttttggggaagtaagcctgggatatccggcgctgattgaaattgctattattttgctggctgcattactttcctttaaaactacggattcggagatccggagggagaaccattttacatggagcgctatccgtgaggttgccgttttatttgtgggaatttttatcacaatgcagccggctctcatgcttttgaaagccaatggcggcagcctgggcattacggagccgtaccaaatgttctggagcacgggactcctttccagctttctggataatacgcccacctatcttgtattcctgaccacggcaggagcgcttgattttacggagggaatgacaacggctctgggggttgtgccgttacagatgctgatggcaatctcggccggagccgtatttatgggagccaatacttatataggcaatgctcccaattttatggttaaatctatagcggatgagaacggtgtccgcatgccgtccttttttggctatcttctctggtcgctcgcaattctgattccggtctttgcactggatatgatattgttctttttatagggagggggatgaacgatgttaaataatgaagagcagctccgggaactggcggagcgcatctacgatctggatgcggaggtttatgctcagttaggttcttccctgggccgtgtttttaacaggaaccgcgaaagctgtgtggatgaactggttaatacaatgctgaccaggccccagggccatctgatgcggagtgaactggcgctgattgccaacatggcccgcacgattaaggataaagaagagcggaagctggttatgacggaatacaaccggattcttcaggaagtaatgagccttcctaccagctttgtgagtggtgatattatcgatccggagatggcgaagctgaacgcattcaatctccaggaccgtttttccagcgaagatcacctgattatctgcattagctggacgtatggctgcggcggcattgatgtcggcttcaaactggccgataaattgaaaatcaactattatgatgccgaaatatttgaggctgtgttaaagcggctggaggcagagaaggatacggtccgcgattcgataggctattcaagcaatccggatctgaatccgaatctggccagtgcatttgaacagacaaagagcctgactcttcggcagagaatgcgtgaattcagccgatatcacggcctttccaagaaagatgccatattctttaatcagagtgacctgctgtgcgatatggccagaaaagaagactttatcattatgggccgctgcggtgatgcaattatgacgaataacagaatcccgcatatcagtatttacatcacggcgccctttgaacagagggtgcgccacacaatggaaatccataacggaatgggggagaagaaggcaaggcgtcttctgaaacacctggatcggcagcattcccattattataatttttatacaagccgccggtggggcaatgcgaataattatgatctctgtattaacagtgcaagttatggaatcgacggtacggtagagttcattctcagaatgattgaccggggcgtaaagaataaaaaataaaatcagctttggaatgccgatttatccggcctttgcaggagtgtcctgcgaaggccgttttttatttaacaggaaagtaatcttgttaaataaaaaacgctccgcggaggctcgcaactctaaagagggcttgttcactaagctcgttacactcgctaagtgagccaatgcctgcggcggtagggaataatgtctcataaaaagaacgaatgttcgaaaaaactcttgccatcaaaatcagaatgtgataaaatggggatagaacaaatgttcttataaatctgtgcagtgatgtgccggtgacaagcagtacaatggattatcacaatgcggttcattgcttatataaaggagaaagttaatgctgatacaggagaatctgtcaatagaagaaaaactcaaaattttaacggatgcagctaagtatgatgtcgcctgtacatccagcggagtggaaaggaaggggaaggacggctgcatcggaagtgcaagtgaagccggactttgccacagctttgctgccgacggcagatgcatttctctcctgaagattctttacacgaaccagtgtatctatgactgcagatactgtgtgaacagacgttccaatgatactgtccgcactgcgttcacacccggggaagtctgccgcctgacgatggagttttaccggaggaattatattgaggggctgttcctcagctccggaattcttgacacaccggataaaacaatggagcaaatttacagaactctttatctgctgcgcaatgagcataaatttaacggttatattcatgtgaaggcgataccgggagccgatccgaccctgattgagatgaccggtttcctggcagacaggatgagcgtgaacctggaacttccaaccgccgaagggctgaggaagctggcgccgggaaagacaagggataagatattaaagccgatgcggcagattcagaggggaattgtaaatcagatggcccgtgaagggctcctggaaaagaaggggattatattgccgccgggatttctcacagactctttaaggactgcgcccgccggtaaaactccggggccgcggacggagctttcggaaagcctgccgcaggctgccggcgcgtcaacgccggtactgtcccgttccggcaccggagcggatgccgaacgccctgcagttattccgggaaagtctgtgtatggtaattatggcgtgggccgtgtatctaatcataagtcgtattttgtgcctgccggtcagagtactcagatgattgtgggagccacaccggagagtgattatcagatgatggcggtagcagaggcgctttacaagaatttcgggcttaagagagtcttttactctgcctttgttcccgtgaatcatgacagccttcttccggctctgccgggaggaccgccgcttctaagggaacaccggctctatcaggcggactggctcctgcgatactatgggtttcacgcctccgaactgttatcagaggataagcctaattttaatgtgtttctggatcccaagtgtgactgggcgctgagaaatttgggggaatttccggtggaggtaaatcatgctccctatgcctctcttttgagggtgcccggaatcgggactaaatctgcgatgcggattgtcgccgccaggaagcaggcagtcttaagatttgaagatttaaaaaagatgggggttgttttaaaaagagcggtatatttcataacctgctccggtaaaatgatgtatccggtgaagctttcggaagatgccatcgcaaaccagatagtgggagaggagaagcggcgaaactgggagcttgagcaaaaggggctgttcaggcagatgtctctgtttgatgatttccatatggaggcagcgcctcctgcggaggaaagggtatctgtcttaacgggggagatgtaatatggttatatttatatgtaaagatgattttgactccatactctgcggcgtttatgatgcctggatgagcagactggggcatgacaatgtcagactgcagcttcagggagcctataatatggagttgtttgcaaaataccgcgatgtgcaggtcaccgaagaaaaggtagataaggtgatacaagctgttgtacaaaagatatccagggaagcgtatggctggatttacagggcgtctctcagttatgaaccggagaaggcagacataatttaccgatttctgatttttggattccatataggaaagcagattacggaaagtctccatatacctgctgtccatgagatattccgaataaaccgccacatacagaatgaggcccataatatgaaggagtttctccggttttctgaactggagaataaagtccttttttcaaggattgggccaaagaatgacgttcttccgatgctggcccttcatttttcggatcggctgaggccggagcggtttatcatttatgatgaaatccgggagaaggctgtcatatatactcccaatacaggctggtacattctgtccggcgaggaggggaaaagactggaaaaactgtcggagaaatcagatcggaaggagtatgaaacactctggaaaatcttttttgacagtgtcgcaatcaaagaaagagaaaattatgtctgccagagaggccatctggctctgaggtaccgcccctacatgacagaatttcaataaaaaaattaagaattaacaggcggataatcctgataaaatcagggtgttaaaaatatattcttacgaattctttcctttttcgaaaaaaaaggaagataattttattcttcattaatagattggtcacaattttgacacaatttcaaattatcattactggcgtaccacgaattaagtaaattgattcaaaaaaagaggagatgtaattatgaaaaaaaatttagtgaaaccagcagcagtaatgatgatgagtgtaatgttagcggctaccgccctgacagcttgcggcggaaccgatgcaggcactacaacagcagccgtaaccaaggcagagacaactgaagctccggagacagcagcaccagaggagagcacagaggaagttaattctgagtcagcagaagatatcacagaagcagctgacacagaggagacagaggcagcagagagccaggctgaagatgctgcggcagaatccgacgatgcagctctgattgaggagagcacagctaactaatcgttagcaggctgataagcctacataaattaatcaggttaagaaaaatgtaaggagcggccgcttgacagcggaccgcttctctcgtatactaagtgtattaaatgaattaatacacttaatttaaataatacgggaaaggaggagcctatgattctgattgactataaagatcggcgacctatatatgaacaggttgtagaaaaactgtctgagctgatggtgcgaggaattttggagcagaacagccagctcccatctgtacgcagccttgcaacggaattgtcgattaatcccaacacaatacagagagcctatgcggaactggagcggcaggggtatatttattcggtaaagggcagaggcagttttgtggccgagaatcaccaaattcgtgaacagaaaaaaaaagaaatttttgtgagactgggcagacttgtggaggaggccaggggaacgagagtcacgatgcttcaatttcaggagcaggtgatacagttctatggcagcagtgacaggaggccgcggccagcggcaggaactgcggctccggtaaaagaatcgcaaattctgccggctgcggaggcgacgttaactgccgtacatgagccggtgacaaagaatcagatgacggaaccggctcttggaggcaagagggaggaaaaaggaggagaaacggatgattgaagcaatcaacctgacaaagcgatttgacgatatcaaagccgttgatcatattaatgcagtaatcagagagggcagcgtatttggattgataggcacgaatggtgcaggaaagagtacgtttctcagaatggctgccggaatactgaaaccggatgagggcagagttacgatcgacggagaagacatttttgagaatgataaggtaaaatcaaaatttttctatatatcggatgagcagtattttttgaataacgcgactccgggtgagatgatgaagttttacagaaatgtatacaggaattttgatgaaaagcgatttttcggcctgctttccaatttcgatttggatgcaaggcggaaggtaaatacattttcaaaaggaatgaagaaacagctttccgttcttcttggaatttgtgccaacacagactatatattctgcgatgagacatttgacgggctggatccggttatgaggcagacagtgaaaagcctttttgccaatgatatggaggagaggaacctgactccgattattgcctcacataacctgagggagctggaggatatctgtgaccacgtgggactgctccacaaaggaggaattctgctgtcaaaggatctggatgatatgaagctgaatatccataaggttcaatgtgtacttcttccgggtacagagccggaaaatctgcacggaattgacattatcaggacggaacgcagggggagcctgctgactctgaccataagggggaaaaaggaagagatagaagcggttatgcagaccttccatccggtattttttgaactgattcctctttccctggaagaaatatttatcagtgaaacggaggtggccggttatgacatcaaaaaacttattttttaatctgatgaaagaaaatacgaaacagcgcctctggacagtcgctttgatatcattaatattcttttttacatttccggtgcagacggcgctgttaatcagcagttatctttcccaggacagaatcgatgccgtttgggagagggaagcgcagggagtcgaggtgataaagcagcagcttcaggaaagatacttaagctggactgcaatagataatggcatgttggtttttcttcttatcgtttttgccgtagtctgcggtatttcgggatttgcgtatctgcattcgcgaaagaaaaccgacttttaccatgcaattccggtaaaacgtgaaagattatttacagtcgtatatctgaacggcgtcctttatacggctgtgccttatctgatatcccttttgatatcttcattaatgattcaggtgaaagccgggcagatattcccgtggggagaggtgttaaagacttactgtatccatatgtcgttctttttgttaatgtatacggtagtgatagcggctgctctgatgaccggcaataccattgtcaatgtacttggaaccgcagtgtttttcctgtggggaccgggaacggtcatgctgcttatcggctatttcagcagctattatattaccttttaccaggacgggaacagattcgtagagcttttgcaaaaatcatcaccggcagcctggtatatcggagcggtatcagaaccggaaaaagcaggctcaatggcgctgtgggcggttgcagtaaccgtacttcttatcgcgctctgtgtatttctgtataagaaaagaccttccgaggcagccgggcgcgccatggcattcagaaaaagccagccggttatcaagctgctccttgtagtgccgattgcactcaccggcagcctgattttcagagaaatgatgggaagcgacggatggagcattttcggtctggtctgcggacttgtaatcagttacgctattattgaaataatttataactttgatttcagaagactgtttgcacataaaaaacaatttgcactctgtacagtctgctcattggcaatccttgcatttttcaggtttgatttgtcgggatttgactcttatgtgccttctgaatccaagatggaagcggcaggaatttactgcaggcggatggacgcggattttcttgaagactatttgtctgaattggagctgaacagtgattccaggggctatgattatgtgagctggaaatcgaaatcagcaggagaactggtgaaggagatgaaactggctgatgtaacgtcggtgattgaaataggaaaaaggggcgttaccgatgccgaacaggcaaagaaacgaaaccacggcatccttagaagcggccgctattattaccgtgattcgagtgacgaaacgattgacgaggtagtggttgcttatcatctgaagggcggaaaaactgtgctgcgccgctataatatgaatctgtcagcggtaagcggagcgctcgacaaaatttatgacagtgaggaatataagacggaagtttatccgattctttcttatcaggcgtcggatgtggcaggaatcaattatgaggaatacggtgatttcagtcatgtgaacctgaagaatgacgaaatgaaggctcggattctggaggcgtatcagaaggagttaagaggcctgactgccgaaacaagaagagaagaaagcccgattgcagcaattcagttcaaaacgggcgagatgcaggaaatgattgatacgctcagagaaaaaaagcgcgacttcagtgtgttcaacagaaaattttattatccgatctatccgtcctttacggaaacaatcagcctgctgaaagaatgcggggttgatgtgggagaattcctgacagcagacaaggtggataagattgttatggaatactacagaagtgaagaagacgtggaagagataccgtctgctgaaatggaaggtgtctactcaaaagagcgcggaagctggaaggtcacggtaactgataagaacgagatccgccagatccttgacagctccctgtctgacagcctgaactgtacaaattatctgaataatacctttaccggggtgaatctgactgcctatgtgtcggtcaagcgggggcagacggaagacgagtttgatgcggctgccatgcctgaaacagtgcagacggagagtatagatggaagtgaacaggagacggaatatgtcagatacggactgcggtttgactacgacaagattccggattttgtaaaagaaacgtttaaattgacggaagaaaatatgaaaaatgatgtaatgtggggctattagaagctgccttaagtggcccggttttacttttgattgactttctctcctttacaggataaaataagtgaggaaaaatatcctgtagaggaggaaaatgaatggcatttttagatgaacttggtaaagtaatcagtgataagagcaaggaagcagccaataaagtgaaggatatcacaggcgtaatccagctcaaatcaaaattgtcagcagaaaaggaaaaagttaataaagcatatatcagtcttggaaaggcatactatgacaggcacgaagcagcgctggaagatgagtacgccgatgaattcaagattatccaggcgggtctgattaagatggctgtactggaagacgaaattgcagaactggaaggaaccagagtctgtgcggagtgcggagccaaggtagagagagaggccctgtattgcagtaagtgcggtgctcctatggaggataaaatggcaggcgcctcagaggatgaggacagtgaagaaccaggactgcagtttccggtaaagacggcggcagatgaatccatcttcgcagaggaagacagcgaaaacgaagaataggagatagaatggacgcattagtacagtggtttacggccaatctttctgagtttatctcaaaagaggcagttatttttattatttccatggtaccaatactggaattgaggggaggacttctggcggcttcgccggcacttctcaatgtaccgattatgcaggcaataccaatctgcattatcggaaatattctgccaatcccgtttattctgctccttatcagaaagatactggactggatgaagctggtgaaggtgttccggccaattgctttgtggctggagaataaggcgatgagtaaaaaagaccagattgagaaatatggattttggggacttgtgctttttgtagggatccccctccctggtacgggagcctggacaggctctttgatagcggcgcttttgagagtgcgttttaaaacagcatttgcagcaatattaataggcattgtaatcgctacggtcattatgtctatcctgtcttacggtgtgctgggagtcattttcggataagaaataacagtctgcggtatggtacggaactttaacatgttcctgccatgccgcagttttttgtatgcattatccggttcagatattcggatacagtatattttcggaaagtatggagattcttgataacgaaacagtttagatggatatttaattaagcaggtgaggacgccgccggtacggccagcggacggggtggtgaggtgtgcatatgagtctttcgtcccgggggtttggcatcgctggatggagaaggagatactgtggttttgttttcgcagggcggagccggagagaatgatatccggctggactgcttcttcgagggatagctctaagacagaggaaggcaaagcccccggggttacggacaaattcgctccgaactccgaatgagttcgaagctcaagttgtcccggattttgcccttgtagggctaaaatccgcccggcgcgctttgtctccctctgcctaagagctatcatctctcgggcgaacgtccttccggatatcattctctccttctccgccggaagatgtcggcagtatctccttctcccggaaggttttcgccggaacgaaagactccgccgggtgtatcggccccgtcctctggcctgcggccgctgagtgtctcacgcgttaagtgcggggggcggaccttgtcgcgggcactcagtgctaccatgtacgggaaatacgatatgccatcaatggactttaaaaaattgcggaagattttgatatcggcctgccgtaaacacgtagtggccgcgacagggccctccccatttaaggttggagacaatcagagcccggaacggaccatgtccgatgtcgaaaacctccgcctgagtgttccgtccccggtgaaaaactgacccggggaagtaggcggaatcaattgcggaggggacatgggagtccgccggtgcttagcgaggtcttttcgagcttagcactccgatgcgcactccaaagagtgcaaacggtccccgcagcaattcattccggccggattccccctccacaaccaacttcccacggggacggaagactcagccagccccctcgccacaccggacatggtccgttccggacgcgtcctcccaacctcagttaaatctccattagatacttgacaattgggaaaaaatcatatatgattaatatacttatagggggtatatgtaatgaagggagataatctatgaaaacggaaatatacaacatagacggaatgtcgtgtgcagcctgcagcagtgcggtagagcgggtgaccaggcgtctggaaggggtgcaggaaagcaatgtcaatctgacgaccgctaagatgacgatcacctacgatgaagcaatggtgactcaggagatgatagaagagaaagtggataaggctggctttaaggcgatgctggttcccgacgaacaagatagaatggcggaagaggaggagacgtttgccaggcaggaggaagcgcttaaagccggcagaaagaggctgattgtggcaatctgttttgcggtgccgcttttatatatttcgatgggacatatggtgccgttccctatgccggtgccggatatcatcgatatgcatgcaagcccgttgaatttcgccctgattcagatgattttaacggttcctgtattaatttgcggaaagaaattttatctggtgggacttcgggcattgtttaaaggcaatcctaacatggattccctggtggcaatcggtaccggaagtgcatttatatacagtttggtaatgacgtttaaggcgttcagcgacccgatggtcgtccactccctgtactatgaatcggcagcggtggtggtaaccctggtaatgctgggtaaatatatggagggaagaagcaaggggaaaacttccgaagccattagaaaactgatggagctggctcctgatacggcgattctgtacgaaaacggtgaggagcgcgaggtggaaacctcttcggtgaaggctggcgatcatatcctgatcaaaccgggcaacagaatccctcttgacggcactattgtaaagggaagcagcagcgtggatgagtccatgctgaccggtgagagcattccggtcgaaaagagcgtgggagacagtctgataggcggaagcatgaattataacggcgccatggaagcggaggtcacccatgtaggcggtgataccactctggccagaatcgtgaagatgatggaggatgcccagggcagaaaagcgccgatatcgaagctggcggaccgtgtggccggggtttttgttcctgctgtcatgggcatagcgattgcagcggctcttttatggcttgttgccggtggaaaagacatggcctttgtactgactatatttgtggccgtcctcgtcattgcctgcccctgcgcactcggactcgcgacaccgacggccatcatggtgggaaccggcgtcggggccagccacggtatactgattaagagcggggaggcgctggaaattggtcacaaagtagataccgttgttctggataagacgggaacaattacggagggtaaaccaaaggtcacggatatttttgcggaacagggctggaaaccgtcggagctgcttcgcgttgccgccagctgcgaacagatgtcggagcatccgctgggagaagcaattgtggcggaggctagggagaagagcctgtcacttgcaaggcctgaggaatttgaaagtattaccggatccggtattaaggccgtcctggaggggcatgaaatccggatcggcaatatcagaatgctggaagccctcgcagcctccggtgaaacgcagagcggagggcagtcagatatttcggccctcacgaatcaggctggaatctatgcggaacagggaaagacaccgatgtttatccttgtggatggaataatggccggaatcatctgtgtggccgacacaataaaagaaagcagcatacatgcaattgataagttaaagagcctggggctggaagtatatatgctcaccggtgataaccgcaaaacggctgaatatattgcacatgaagcacatattgacaatgtgatagcggaggtgctgccgagtgataaagcgggaactgtggcagacttgcaaagtcaggggaaaacagttatgatggtaggagacggcataaatgacgctcctgcgctggtgcaggctgatgtgggaacggcaatcggttcgggaagtgatattgcccttgaatcgggtgacatcgtattgatgaaatctgatttgatggatgtctacagagcggtgaaattaagccgcgccacaatccggaatattaagcagaaccttttctgggcgttcttctataattcgctgggaataccggtggccgccggtgtgctgtatctgtttggaggaccgcttttaagcccgatgctgggaggctttgcaatgtccttaagttcggtctgcgtagtatcaaacgcattgcgtctaaaaggactgaaacttgattaattcaggctcagctgacggagccgggaagcaaaatagaataaaaactgtataaagggggaacgggatgagctgttgtggaaacgaggagaggcataagcacaggaacctgaccgaagaaaaggatttattaaaaaggcttaacagaattgaggggcaggtgcgcggcattaaggccatggtggaagatgagcgctactgcgttgatattctgaaccaggtttctgccgtccaggcagctttaaacggcttttccagggtgctgttgtcaaatcatataaagacgtgtgtgatagatgagattgaggcgggaaatgcagaagaaacggtggaagagctgtgcaagacaatccagaagctgatgaaataataagaatttgtaaaggagataaaaataatgaaaaaatttaaatgcgaagaaattatgtgcggcaactgtgtaagccggattgacaaggcccttactgcggcggagattgagcatcaggtagatttgaattcaaaaacagtcacaattgagggatgtgaacactgtgaaaagaaggcagtggagatcctggacgatttaggattttcggcagtggaagtttaagacgcagtgcgagcctccgcggagcggtttttattgacgacggtgacctgtgcacggagcgtgccgcttatcgtttaacaggagaaaattcctgctaaaaaaatctgcgtatatctgcgctggaatttgtaacagatatacgcagacaaaccttccaatatgacttaaaaccttgctgcagcggtgaaaaatgaggcagttaaggaattgtattaattgcatgaaaaattttttaaatttttctcaggaaatggttgacatttcctgatatttatattatactaccaaaggtatcgaggcgtggctcagtttggtagagcgctgcgttcgggacgcagaggtcgcgtgttcgaatcacgtcgcctcgattacacctcagtatggcctgttggtcaagcggtcaagacgacgccctctcacggcgtaaacccgggttcgattcccggacaggtcattttagaatctgctttggagtgaatccagagcattttttaaacgcttccgtggctcagttggtagagcaacgcattcgtaatgcgtaggtcgccggttcgagtccggccgggagctgtatggtaagaagtcgaaattccttgtaaaagcaaggggtttcggcttttttgttgatggcggtgacccgtgcgcggagcgtgcaggttatcgttttcggcgccccctaattgatggtggttcgcactatggacgatttcgattttcatgtcaataaaaagatttcaaaagatgaactgcataaaatggctaaggagattattgatttaaaacaggaaaagcagtagaaaacacatctacataattctatggtcatatactccatttatcgggggctcgtcattacgacagtcctcgtattgaagaaatataattggagtggcagtctcatgtccgtccgttaactgtatttgcattggacattcataaaaacaagggcagaagaaaaaatatttcaactgcccttgttttcactattctgttttatttctgtatcatccatatgtaattaacaaagtatattaatgcaccagattacaaacggctgataaaacacatcaattaaaaaggctcctacaatcggcactatgataagcgctttacgtgataccccatacttggtatgaatggttgtcatattggctacggccgttggtgttgaaccgagatcatgaccgataagtcctgccgacataacggcagcatcgtagtttttcccaagaatacggaatacaacaaaataagtgagaagcagcagtatgacagtctgcgtgcaaaggacgattaacagcggtagcgctaattcggccaattcccacagcttgagcgtcagcagcgccatggacaggtacaagcccagactgatatcaccgacccgatcattgaaatcaatgctgaaattgtaaaaatgaaacttttcatttaagtttcggaccaagacggcgaagaacatggctccgacataggtggggatagccatgccgattaaaccgcctaaataaccgacaatcatggagcccattgtcatacagagcatcagtgcggtaagatttttcatggtgttggcataatccatttcgatatgctgtgcaccggcgtcatatccggaggtatcaatttggaaaccatcatcattatcgggcgtcagattataacgttctatcagccgtctgcccagaggaccgccgacgaggctggcgacgattaatccaaaggtagcggaagccaaaccgaccagactggctccggggtaccccatggcttccagagtctgtccataggcggcagcgcctccatgcccgccaaccagtgcaacaggaccggagacaataccgtacgcggcgtcaagtccaagaaccggtccaagaaacacaccgataccagtctggaggacagtgatcagtacatttacaaaccagtagataaataaaagcttgccgcctgttaaaagaactttcaggctggccccgaggccgaccgtcgtgaaaaaggccaacataaatactgtctgtaaagaggcgtcgaataccagatttattctaccgctcatgaagaataaacagtttagaaaaacgaaaagaaatccgccgattacaggtgccggaatacaaaatttttccagaaaataaactttgcttttaatccagtaaccaatcaacagcaggattgcccccagggtcattgtaccgacactgtcaaatgacaaagtgaaaattgaatctgcaagctgcatttccataaatactacctccttttttctgtcgaattagataagaatttctactatatttagttaaattatatcgattttatttgattctgcaagatgaaatgcgtgaaaattctgtaaatattttaatgttattttatttgtgctaattttttgaaaaaataaaaagataaaagaggcgctctgcacccggtccatattacgaataacggttctcattttcatgaaagggaataaaatgcagaataaaaaacaaaatatatttgaggagaactgaaacgagaagtgaaccaaggcgggattgggatgaggaggtgaaaaatataaatgataaaatttatgaatttgatgctgtaattcagaaagtacccgatattgacggagcctatgtaaatattccttttgatgtgaagaaagagttcggcaagggaagagtaaaggtgcatgtggattttgacgggacagcctacgaaggaagcattgtcagaatgggaactcctggccatattttgggggtgagaaaggacatccgtgctttgattggaaaacagccgggagataccgtccatgtggtcatgagagaacggtagtacctgacagtcacatatctgctcaatatgggaaggaagggcggtcaaataccgcccatgccgtcacgggagcggcactcttttgggagcttatccggtctcagacctttgaagaccggctgccgcataccgccatttgccgtgtactccataaattttacgacacaaaccaattgaggttcaatccagatcgcattttcattaccatgcggaggtgcaaaaagaggggaggggatctgtggcacttctttaatacgctgaaaattttcccctccgacaccgagagttacatgacctttatagataagctgctcatgctcatactgtcccagaacaacacttatcatattattgtccttaaatatatatccgcagactacaaaatcatcgtctatcaggttttttattttgatccagtccttcgttcttttaccttctatataaaaactgtcttttcttttggcgacaatgccttccatgtcctgttgtttggcaagtgtgtaaaatgccataccctggccctcgatgtatttggataaggccattcgtgctgtttcctcacctaccgctttggaaagatatactttgcgctccataagcggcagcaatgttaaatccctgtctttgtaatataaaatatcgaaaggtataaagctggcaggatattgttttgaaagcaactcaattttaaacggattagacatcagactgcgtttctgtatttcaaagtagtcagatttgccgttttttaaaatgattaactcaccgtctaatatacatctggctttaacctgcttgtgtagatgagtaagctcaggtactttagaaagcattttaagatttcgtttattccggagctccgtaccggtctttggatccagataggcaatgcagcgctcgccgtcccatttcaattcatagatatagtctgcgctgtcaaatgcatccccgctggcgccgataagcatcggatgtatcacttttgcatcgaaatcaatcatgctgttgctgccttcttccgtccgcgcggcttcttcgggggcgtggtgccttcaatctgctgcagagaggcctgcagcgcttccataatattgattacgttgctttcctgctcagccggtgtctgaacaatttcctgtccattgatttttgcttctataatttctctgagacgaacctgatactcattatggtacagctgtggttcaaattctttatccatcgatccaatcagcattttcgccatattaagctcagcctcgttcagttccggatgtgctgcttcctttggtatttctttaacttcatcatagaaaaagagtgtttcggccaagatacctttctcggtcggaatcagacaaaggagtttttcgctctgtcccattactgtttttgcaattgccacttttccttcatcgaacatggcctggcgcagtaattcatatgctttatcacctccggcctcgacgactgcatgataggttttgtcaaaaaagatgggacggatgttttttaaatcagtaaaatgcaggatctggattgtcttgtctttttccgtctttgccttttcgaaatcagcgtccgtcattgtaacgtattgcccgggagcaaattcaaatcctttcacaatatcctgaaagccgacttcttttccgcagttggcacagacctttttgtatttgacacgtgaaccgtcttctttgcacaattgattgaaatgtatatcattatcctgtgtggcggtgtggagcgccaccggaatgtgaaccaggccaaaactgattgcccctttatgcgtagctgccatatgcttgttttactccttttttaccttagtatatacaatttctcctcaacaatccaaattagcctgatatattgattaatcatactgattctttcacagcattcataagatagaatgaaaacagggtccgccggagcggatgtctaagctttggcaaacagaggaggtttttttattcacagaatattggatgagaatttttttgatatggtagttaataactcgttatctgttccaatggaaagtgatgcaggtactacacggttgaatgacagatattctgtcatacatctgcctggcagcgaattcagcatgtgcggcctgggaacatatccctaccacacattcccaggtatttataccttgaattccaatataagtctggaacagagcggaattaatgtagtcaggaacaacccgaacttatcgctcttcgggcagggcatcctgattggaatcgtggacacgggaattgaatacaggcatgaggcatttttgaatccggatggttctaccagattattctccatttgggatcaaacgataacggatggtgagcctccggcgggatttacctttggaacggaatacaataaaacaatgattaacatggccttaagaacacaggagcctcttgccgttgtaccaagtattgatgagttgggacatggaacaatgctggcgggaattgcggcaggcagcaggagggaaacggataatttcagcggggtggctccggaagcagaactggttgtggtaaagcttccgttggcgaagcagcttaaccgaaaaatattcagcattccgtctgatactgtctgctatcaggaatcaaacattatcattggaattgaatatgtattatcaattgcccaacgtctgaacagaccgttactcatctgtataggtatgggctcctcccaaagttcccatgacggtcttggtctctttgccggtactttaaatcaactgtcggcattgccgagaatcggatgctgtgtggcggcaggcaatgaaggaaatctcagcagacattatcacggaacttttaccgatcagatcatggcgagaacatttgaattaagagtaggagaaaaagacaaaaacttttttatggaaatatggcagaggtcacccagccggttaatgataggaatcagtgcgcccaccggtgaaacatttcatgcaataatgcccggcttcagtgaatgcagggaatataaatttttattcaatccgacaaaaatttatatcaacaatattattgttgaggaagagtcaggggatcagttgattttaataaggttcaatgatgccgtcaatgggatatggacaatacgggttaacaatattgagacaatagcaggagattttaatgcctggctgccggccggtaatattatttctaaggatacttattttcttgaaccggaccctgacaatacaataacatctcccggcaacgcacgtaatccgatgacggtgacggcctataatcaaattaataacggtatactgccggaatccggaagggggtatacgacaagcggcttggttgaaccggatattgctgctccgggctttgccctgtcatgtccgactattgccggtacgaatacgtatggttcggtaactggcacgggggcggcggccgcacatgcggcgggagcggcggctcttcttatggaatgggcggtattgaggggaaattatactacaattacagggagagatattaaccggctgtttatccgcggggcaattcgtgataaagcagttgtatatccgaataatgtgtggggatacggaaggctggaccttatgggggtattgagcagtctggtataaggacaatgttaaggagataggactgacagaagcgccggcttaaaataccagcgcttccaagtaactcaaagaaaattaatttttgtagcgtaagcctcgccattaagcggtttataaatatctacgacggcaaaacgagtcggcagttcctcccgttttggttcagctatcgtgataaaacggtagtttgttccgttgacaatctgtttggcaacagcaactggattataaaagtaattttcatgttgccctatggcattgtaaaaaataaaggagtcatagggcgtgaggtatgactgataagtccagcctcctggcataattacacctcgaacagcaaagttaatgtattgtatgcatatttggaccgccgtgtaccagggggattctgcacataaataagttgaactttttctcaaaatcatggataataggaataacggaaggctttaaggaggaacagcatatgaatttgcagtggctgtactatttcaatacaattgcagaactggaacactacacgcgggcggcagaaagacttcatgtcagccagtctaatttaagtcatgccattaaagagctggaagaggaattaggcgcagagctgttcgagagaaaaggccggaatatcaaattgacaaagtatggtgaaatatttcagccttatgttcagaagacgattagttctctggaggaagggatttcaaccttaaaagaatatattgatcccaatgtggggacgattgttttggcaggcttccagtcggtcgcccagtttgcaacggatctcatggtccgctatcagtcggatacaaaccgtctggaagtgcagttccaatacagccaggaaatctggaagggaattcaaagcaagctgctggacggctccgtcgatctgattattggaacaaggctcagctatccccagatagatgccgcgtacatcggcacgcatcctttgatggtgctgataccggagggacatgagctggcgtcgggggacagtgtggatttaaggaaactggacggtgaaaattttattgcctttgacaccaatgcccagctgcgcggacagcttgacaatctgtttaaagagataggaatttgtccgtgtatcgtatccgaaactccaaatgatcagattatttacggcctggtcgccgccagaaggggaatctcaattgtgccgtatccgctttccggagcgccttataatacgaaaatcctcccaatagccaatgatattccacagcgcaggctttacctgcagtggaataaagaacgctatattccgccggcggcgaagtatttcagggactacattatccgcagcggcgaggtgttcgaccagtatctggagcatcatgggatgatgattcattaaaataatgttcaccgttttcatccattctccagtcagatgaaatcagttcgatgcggtcagaagctcaccctggagaagagcatgcatactgctgaacaatcagattcctgactttctgcaccgccggagtcagcggccggctgcggtcccaggaaagataaactgtcctgagaaattcctttcccttatcatcgatgggaaccatgcggacgcgttccgtcttcattgcaggaacctcggggaggatcgagacaccaaatttgagagacacatactggagggcggcattgcactcccgcacttcaaacacgacttttggaataacgccgcgctttgtaaacacctgatcaagctgtcttcgcaggctgcttgccttgtcgagcatcaccagtggttccctggcgaaatcctcaaaggtaacggaagaacgctcagagagaggatgctcaaagggaacggccagatagagaggttgtttcataatggtgatggaatcagcccattcatcccggtgcgtacaaaatgccaaatccagcttaccgcttttaagcagtgtaaaaatgtcaaaggaagtatcctcggtaaaatgaaaacgaatctgtttattctccgggagacggtatacttcttcaaccatggaggggatcagggaggaggagatggaatggaaataaccgagacggacaaccagcggggcagttcccgccatctgcttcagtgtgttggttccctcctccatcagcatcagggatttctggacataggggagaaatctctcaccataatccgtaagacagattttccggttctgtttttcaaacagcttgaccccgagttccttttccaattcattaatggagtaactgaggctgggctgggcaatgtgaagttcttcagccgcgtgggtgtaatgcagcacgcgggcaagagtctcaaaatattgtaattgaagcagagtcatgatgacaccatcctttttcaatctatcacgctttcgtgaaaccgtactcatagtatatcataagccgcaacggatttctacaaaaaaccgccctgtgttccggcctccatagaagctttctatgaaaataagagaaatacggtattggactttttggcctgtgtccattataataaaccggcagggtgcagagcagagagaagctctgcgccctgtttgcgaaatatggcatattataaaaggagaaagagagaatgctgcaatttcacggaaatgagaattatattgcttcggatgaactgatccgcagcgtcaacatagctgctgcgcttaagaagccgctgctgttaaaaggggagccgggaaccggaaaaaccatgcttgcggaggcgattgcaaaatcccttggaatggagcttttgatttggaacatcaaatccacaacaaaggcgcaggacgggctgtatgtttacgacacggttcagcgtctttacgacagccagttcggcgaggaaggcgtaaacgacattgcaaagtatatccgtctgggaaaactcggtgaggcgtttaaaagcagcagacaggcggttctcctgatagatgaaatagataaagcggatttggaatttcccaatgatcttttgtgggagttagatcagatggaattttatatcccggagacgggggagaccgtaaaagcaaaggtccgtcccatcgtgatcattacatccaatgcggaaaaggagctgccggatgccttcctgcgccgctgtatcttccattatattgcgtttccggatgcgccgatgatggagcggattatcaaagcccattacccagggcttgaggaaacgctgattgggggagttttggacgccttctaccggatacgggaacttaaaggactccagaagaagccgggaacttcggagatactggactggattcaggctctgaatatcggaggcattcctgtggaggtccttgaacgggaaattccctttgccggcgttcttttgaagaaaacggaggatttaaaacaagtggagaaccaatatgttcactgattttttatatattttgcgcgggtacgggatgaagaccagcctgaatgaatggaccggcctgatggatgcgctggatttaaatctgaatgaggccagcctgacggaattttaccatatggcaagggcgatcctggtaaaaaaagaatcggactatgacaggtttgaccaggcgtttctggagtattttaaaaatgttaaggaacaggactgtctgcctgaggcgctgcaacgctggctgtcgagggcgatgacgcagacgccctttgaccgggaagaggcagacgcgcagtggggaaaaaagaatatagaagaaatccgacgtctgatggagcagaggctggctgaacaaaaggaacagcaccacggcggaaataagtggatcggaacaggcggaaccacggcgttcggtcactccgggtatgcgcagaaaggcatccgggtgcatggaagcgggatgagcagaagcgcgctcaaagtggcgggagagcgcaattaccgtgacttccgggaggataaagtcctccagctcaggcagttccagatagccctgcgcaagctcaggctgctttccagcaaagatgacggggccaggacagaactgaatgtgacgaaaacaatagagaagacatgtgaccggggcggacggctggaacttgtcttggagagaccgagaaagaaccagacgaagcttctgctgttaatggacagcggcggctccatgtgggcctatgccgatctgtgtaaccggctgtttcaggccgtgaaccaggcgtcccagtttaaggacttaaaaatctactatttccataactgtttttatgatcagttatttacagcaccgcaatgtaagtgggaggacaaggtttccactgaatgggtgctccataacctgaagccggaatacaaggtgattgtcgtgggagacgcgactatgggaccggcggagctgctggagcctggcggtactctggactacgaccatgagaatgataaggccggaatagactggatcaagacattaaagaaacgctttacgtctgctgtctggctgaatccgctgcacgaaaagctttgggattatgatgcatctacccgtacaattcaaataataagagagcagtttccgatgttcccgctgacggtccagggcctggaggcggctataaaagagctgagaaaaggagaggcgtaatgcctctcctttttttgaagacggtgatctgtccgcggccttcggtcttctatgcaagactgtttataaaagaagaaagaagatcggcagggagctgtcccggcgcggaggccttgcctgcggtgccgaaggtgatggcggatccgaatacacttccgcataccctgctgataattccctggcgccccatggacatggtgataacaggcgtctccttatgttcttcgcgcatggtgagggtggcgtccagaagtgtgaggacatcccgctcattctgcggcattacggcatatttggcgatatcggctcccagatgctgcatctggcagagacggctcacaattgtctccttcgatggcgtcgaggtggtgctgtggcgggaagctataattttcatcccggcgcggtgggctgcctccacaagagtcctcatcgtatcgtcccctttggacagttcaacgtcaatcagatccataaggccggtctctatgacgtcaagattcattgcaatatattcctccgtttccatgcccgccattccgccctccgaatcagtgcggagcgtgaacagaatcggagtatcccctaactggtcgcgaagataagccatggcctgaaatcgtacctgcggattttcaatattctgataaaaatccgcacgccattcaacaaaatcgaagggggcacttttcatcgctttgacggactgtttaagtcctttcaaatccgtatccgtgagcggaatgcatattttagggattccttctccgaacactacgtttctgatctttacggctttcatagcatattctccttatacacggtgcgctttgctgcgctcaaccgttaccaaattaaaggtttttctaaatgttttgttacagtataaaagcttagtccggtaatgtcaagagttttttactttaaactactgaaatttaaagcaataaagcgatggcatgctgcacgcagtaaattccacggctttttataacatcttaattcccttataggttttatttttaccggtttaacggctgcggtgcaaggataaaacggtaaggaggaatggtttatgacttgtattattcagacattttacaattttgaattaagatttgattcggcagtcaagctttttgcccgctttcatccgtatctgtttattgtctgtgcatttatcgggatacccgtttttatccttggcatggtgttttccctgaccgcggcatttatgctgccggcggcctgcctgttcggatagtgctgaggagcctgaagatgcatcctaatacaatctttatacgaatccggccgggctaacacaatttttataacacaggtgctagaatctgttttataaaaatcatcggagcctgtaataagctgcgacccggtgaaactaaaggaggaaatgagatgatggatatttgcatgatcggtattattatagtgagctgtgagctcatgaaactgctgattgactggtgtgagtcacaggttggcccgggagagcgaaaatgagaattcaggagcttgagcggtaaacgccggatgcgctgaatggaaaaggagtggatcatatgatagttttgggcattatcattgcagggcttgccgcgtatcttgtatacgcgcttgtgtatcctgaaaagctgtagttaaagactcacgaggaggaagataataatgtttcagatattaataacattgcttatttacatggttctggtgattccgatcggcatttacctgtaccatgtggcaacaaaacagagaacatttgcggatcctgtatttgaccggattgacggtatgatttacaggatctgccgcattaacagagaggatatgcactggaaaacctacgcattaaaccttctgatgacaaatgcggttatgatactgataggatatctggttttgaggctccagggacttttgttcctaaaccccaacgggatagcatcgatggaggagagcctgtccttcaataccattatatcctttatgacaaatacaaacctgcagcactattccggtgaatcaggcctgtcctatctcagccagacggcggttattatttttatgatgtttacctccgccgctaccggatatgccgcctgcatggctttctgccggggaatggccggaaggccgatggggaatttttatgaggatatggtgagaaatacaacaagaatcctgatccccctctcttttattgcaggaatgcttcttatctggcagggtacgccccagaatttccacgcgaattttacggtttcgacgctggaaggtaaatggcaggatattgctgccggaccgattgcagcgcttgaggctatcaaacatgtgggaacaaacggaggcggctttttgggagccaactcgtcgacgccgttagagaacccgacgattatttccaatctagtggagctgtactccatgatgattttaccgggcgcctgtgtcatcgcatttggcaatatgattgcggacaaacggaaaaaagaaggaaaaaaatcgctcttcggcagacagggcagaacggtctttgccgccatggcaattatttttctgattggagttgcggtatgtttcgcggcggagagtgccggcaacccggttcttgccggaatcggactgaatcaggatatgggatcctatgaggggaaagaggtaagatttggaattgcccagtcggcgctttttacaacgacaacaacctcctttaccaccggtacggtcaataacatgcatgactccctgacgccgctcggcggtctggtgcctctgttacatatgatgttaaactgcgtgttcggcggcaagggtgtcgggctgatgaatatggtaatgtacgtcattttagccgtatttatctgcggccttatgatagggcggaccccggaatatctgggaaagaagattgaaggaaaagaaatgaagctggtggcggtctgcctgattatacacccccttctgatacttggcttttccgcattggcagtatccacggcaggcggtttggcgggaatcacaaatccgggattccatggattgtcccaggtgctttacgagtacagttcttccgcggcaaacaatggttcaggctttgagggtcttgcagacaactcggttttctggaaccttacgacggggattgcaatgtacttcgggcggttcccggcaattatactgcagttggcaatcgccggaagcattttcgcaaaacgcagggtgaacgagacggtcggtacgttaagaacggataatgtggtatttacactgattcttgtctttgttgtatatatttttgcggcgctgacgttcttcccggcactcgcactgggaccggttgcagaacatctgacaatatggttcccgggattaagttagcttaaggaggcagaagtgatgtcgagaaagaaacagcagacaactaaatttattacaaaagatatattgaaaagctcggtaatcggggcatttaaaaaactggatcccaggtatatgcttaagaatcctgttatgttcgtggtggaggttggttttgtcattacatttgtactgtgtttcatgccaaacctgttcggggatgtgaccgcatccggtggaatctctgaaggagccttaagaacctataatattattgtgacattgatacttttcataaccgtattgtttgccaactttgcggagtcggttgctgaggggcgcggtaaggcccaggctgagacgctgaagaaaacaaagaaggatacggtggcccatcttgttttaccggacggctctgagcgggatatacccgcctgcgatcttaaaaagggcgatgtggtgattgtgagaatcaatgaactgattcccaacgacggagaagtagttgagggaatcgcatcggtcgatgaatcggccatcaccggagaatcggcgccggttacccgtgaatcgggcggagatttttcgtcggtcacaggaggaacgacagttgtatcggactggctgaaggtacagattgcggctgagccgggtgagtcctttcttgataaaatgattgcgctggtggagggggcgtccagacagaaaacgccaaatgagatcgccctgaatacattgttagtcggcctgaccatcatttttatgattgtaattgtggcgctgtatccgtttgccgtttattcaggcatccatatcccgatagcgactctgatcgccctgatggtatgtctgattcccaccacaatcggaggcctgctctctgcgattggcattgccggaatggaccgagtgacgcgttttaatgtcattgccatgtcgggaaaggcagtggaggcctgcggcgatgtggatacgatgattcttgacaagaccggaacgattacttttggaaaccgccttgcagccgatttttatccggttaagggagttacggtccgggagctgatggaatactctgttctggcttcccttgaggacggtacgccggagggaaaatcgattgtggaactggcgcgcaagatgggtgctgtgacagaaaaaaatgctgcggataaaatggaatttatcgaatttacggctcagaccaagatgtcgggcgtaaaccttgagaatggattaatgctccgcaagggagccggtgaggcaatcagagaatttgtagtgtctaaaaacggtaagattccggccgatttggatgggattgtggaaaatatatcaaagctgggcggaacaccgcttaccgtctgcgcagataaccggatctacggcgtatctatctgaaagacacagtgaagccggggctggccgaacggttcgccagactcagggaaattggcattaagacgattatgtgtacaggagacaatccgctgacggcggctacgattgcgaaagaggccggagtggacggtttcatagcagagtgcaagccggaagacaagatcacggaaatcaaaaaagaacaggctcaggggaaaatcgttgccatgaccggcgacggaacgaatgatgctccggccctggctcaggccgacgtgggaatcgccatgaattccggtacccaggcggcaaaagaggcggcaaatatggtcgacctggactcggatcctactaaaatcctggaagtggtcgaaatcggaaagcagcttttaatcacaagaggctcccttaccacattttccattgcaaacgatattgcgaaatattttgcaattattccggccatgttccagctggtgattccgcagatgaacatgctgaatattatgaagctttcaacgccgtacagtgcaattttgtcggctctgatatttaatgcaatcattatccccgggctgattccaatcgcgatgaaaggtgtaaaatataagccgatgcgttcggagagaatgctgcttaaaaacatgggaatttacggcgccggcggtgtaattgtaccgtttgtgggaattaagctgatagatatgctcgcggctcccctgcttgcagcgttcggcctgtaggatgacgggaatgaagcatgtcgaacacatcatatgccggaactgaaaatgccgggtaagaaaacagaaggagacggttatgaaattatttatgaaatatttaaagaatgcagtaaagtgtacggtagtgctgggcgtcctgtgtacggtcatatatccggcagcgctgacactggccgggcaggcgctctttcccaaacaggcgaacggcagcatggttatggctgtcatagacggtgaggaacgcgcggtcggttcgaaatatgtgggacagcagtttgaggatccccggtttttccacggcaggatttcatcagtcaattataactgctatacacaggaggaaaaggaggacggcagctatggcggtgtcgcatccggttcatttaactatggtaattccaatcctgatttaaaaacaagggtggaagcagatatggctgcctggatggaagcgcacccggacgtaaaacaggaggatataccgtcggatttgctgacggcgtccggatccgggctggatcctcatatctcggtccagggagcccgggtgcaggtcggtgaaatagcaaaagcatccggtctgacggaggaagaactgaatgccataatagacaacaatacgcaaaagaaagcgcttggaattttcggtgaggaagcagtcaatgttctgggatgcaacctggagattgcaaaccggctcggaatactcaccctgaagtaaaacaaatatggtaaaaggcacattggcggccattgcgccattaagcagcaggatggaaagaagcctccggaaaaatctgtccggaagctttcttttttttcatagccatctgtgttaaaataatgacggaggaaaagccgcaatagaaatctttatacaatcttaatgccgcggggcgtttccttatacggctttaaataataaattgatatacttttcatagattgaggtgattttaatggaagagcgcagaagcagcccggaggagtttttacgccggtgtgaaaatgagaaccaggcaaagggccgggggagtctgaaaatatttttcggatatgcggccggggtaggaaagacttattccatgctgaaagccgctcacgcggcaagaaggcggggaatcgacgtggtggccggttatgtggaaccgcatgcgcgtccacagacctcccaactgctgaacggtctggagatgattcccgcaaaggagatccggcatgggaatgtggttttgcacgaatttgatctcgacggcgccatagcgagaaagccgcagctgattctcgtcgatgaactggcgcataccaatggaaaaggatgccgccatcaaaagcggtaccaggatataaatgagctgcttaacaatgggattgatgtttacacgacggtaaatgtacagcatatagaaagcctgaacgatctggtcgcttctattacgggaattacggtgagggagagaatcccggattccgttttcgataacgcggatcaggtggagcttgtggatattgaaccgcgggagctgattgagcgtctgcaggaaggcaaaatatatcgtaaaccccaggcggaaaaagcccttggcaattttttttcagtccagaatctcgttgcgctgcgtgagatcgcgctccggcgctgcgcggaccgggtaaaccggatgtcggaactgaccggaggacggtctaaccgcagctttacggaagagcatattctcgtctgcctgtccggttctccgaccaatgcaaaaataatcaggacggcagcgcgtatggccggtgcatttaaggggagctttaccgcagtatttgtggagacgccggattttgcctctgattcggatgagaataaagatcggctcaggcagaacacccggctggcggaacagcttggggcgacgatagaaaccgtgtacggggatgatattgcttttcagatagcggaatttgcccgcctttccggaatatcaaagattgttctgggcaggagcagcacccggcgcagcttcttgggaccgccgcctctgaccgagagaattacaagactctctccaaacctggacatttatattattccggatcagaactcccgtccttacagggccggagcacgaggttcaaaccgccggatactgaatacggccgatctgattaaaagtgtttcagtattggcggcggcgactttgatttgctgcatattcgactgcctgggactcagcgaggccaacattataaccatatatattctgggtgtgctggtgacggcagtaatcacccggcaccggatatacagcctgacaagctcggttatctgcgtgctgctctttaatttcctgtttaccgaaccgagatttacgctgaatgcctatgatccgggatatctggctacctttccgattatgctgattgcggcgtttctcaccagctcgcttgccgtgaaaatccagcgtcaggcgcgtcaggctgccgagacggcgtaccggaccaaggtgctgtttgatacgaatcagtccctgagcaatgagaaagacatgacaggaatgataactgttacatgcaaccagcttacaaagctgctcgaccgcgacattctgttttacagaatacaggatgacggactggcggcgcctcagctttttgccgtgaacagcggagagaatgtgtcggattacgcggatgacaatgaacgggccgttgcatcatgggtataccacaataataagcgcgcaggcgcgacaaccggaaccctgggcaatgccaaatgcctatatctgtcggtccggctggcgcaggaggtgtttggcgttgtggggattgcgatagacggcagaccgctgggcgcatttgaaaacagcataatgctctccattctgggagaatgtgcccttgcccttagaaatgataaggtatcgaaggagagcgcggccgctgcgctgcttgctaaaaatgaacagctccggtcaaatctgctccggtcgatttcccacgacctcaggacaccgctgacctctatatccggcaatgcgggtatccttctgtcaagtgaacagagtatagggaaggaaaagcgcaggaagctgtatgaagatatttatgacgattccctctggctgattaatctggtggaaaatttattgtcggtaacacggattgaggacggtacaatgaagctgaggctggcgacggagcttctcgacgaagtggtcggcgaggcgctgcgccatacggacaggcggaggtgtgagcataagattaagataaagcaggaagaagattttcttctcgtaaaagcagatgcaagacttatcatgcaggttatcataaatcttgtagataatgccattaaatacactccccccggttccgaggtggtaattgagacgaaaagggagggaaatctggctgttgtaacggtagcggacaacggtgacgggatatccgacgagtccaaggaacatatatttgatatgttttatacggcagctaccaaaattgccgacagccgccgcagcctcggcctcggcctggctctgtgcaagtccataattaccgctcatggcgggacgatttctgtagaggataatgtcccccacggagccgtgtttacatttacattaccgatggaggaggttaccctgcatgaataaaccattaattctggtagttgaagatgatgctgccgttaaaaatcttattactacaacgctggaaacccatcaataccgtttcaggaccgcatcgaccggagagacggctgttatggaggcggtttcccataatcccgatgtgattcttcttgatctgggtcttcccgatatggatggtatcgatattatacgcaaaatccgttcctggtccaaaactccgattatcgtgctcagcgccagaagcgaggacaccgataaaattgacgccctggacgccggcgcggatgattatctgacaaaacctttttccgtggaggaactgctggcgcggctgcgcgttaccttccggaggctgaacgatgccggagacagcgctgcggctccggcttccgtgtttaccaacggcgagatgcgcctcgattatgcggcgggcaccgttacgatgagcgggcaggaactgcaccttaccccgattgagtacaaactgctctgcctgcttgcaaagaatgtgggaaaggtgctgacgcatacgtatattacgaaaaaaatctggggtagcgcctgagacaatgacgtcgcctcccttcgggtctttatggcaaccctgaggaaaaagattgagcctgatccctcaaatccgcagtatatccagacacatatcggagtgggatacaggatgttaaaggtgtgagctttaaggcgtaaatttaatcatgacataaaataatattacgaaagcatctttctgcggcagcttgtcccgacggggctgagcttcacaaagaggtgctttttgccgtccggaggcggcaggttcagttctcatcgccaatcgaggacagaaacggcaaaaaacgccgtttcgcgccgtgtcccccgggatatatcagaaaacttgaaataaatcccgttattcagtataatgaatccatatctttacaactacagcagaacagcagaccgggcggatacggaggccgcataaatatggatcagacctttttactacagttgaaccggtggaacgaggaagaagagtatcagaaaattatagaagcggtggaagccctgccggaggaggagaagactccggtactgatcagtgagatggcctgtgcctataataatctggctgaagcggacgacagccgcctgtttgaaaaggcggcagagctgctggaatcggtggaagaggagctttcggccgatcacagatggaatttccgcatgggatatgcctgttattatctgaacagggaaaagaaggcaaaacattattttgaaaaagcgctggaagctcttccgggggatgaggatacactatattttataaaagaatgcgagcgctgtctggctctcccgatctcgatgaagccgttcaggcagagggtaaaagagggatgggattccttcctggccggagaggccggacttcgggaacagattgaacgaagagaacatggagaggaggtggcggcagctttaagccgtctgctcgcaccggcgttccggaatatctgcttcgagattgggttcaacggggaaaaatacgatttgatactgaccccggacggcgacagggcaaagattttaaaactcgtttattttaaagaccatgccccggaggaggtttttcatcactggaacattcagattggccggcagcctgccaaagaatttgaactgagtatgtacggccaaagtatcggcacgaaagacgcctttgtctgggtggaggaactggatgacgaccagattgggctgtccgtgttttgcgaaaagctgcttcctcttttggaagagaatgaagacagggcctattcactgatggcggttcttctcgatcagtcgattggtgaaattcctgcaatccgctatatcggatatatggatttgctcaaagaacccaaggacggcggcgacgcgattctgcttgatgagctgaaaggatgcatagacggaaaacgggccgtcacgccggaaaatttgtgtggctggtatacctgctattcaatggaaccggatggacgggaagactggtttttgcgtgaagataccattgccggggtaacaacctgtccggaggcggtcggatgttatttccggggagatgaccggattatggaagaatttcatcaggatggcgcggtccccggctttttctactatccgctggaaggcattgagcgcggaacgattctggacatgcgggacagccttgaaaaagacatttccgacagagccggcgatgcggtgacgtttaccggcggcgctacggggacggattacggatatctggactttgcggcctgggacctggatcggctgcttaagtctgcaatggctgtttttaacgaaagaaagctggaagcagcattccatactttcagaagggatgtaagcggcgttgcattgagacggaagggagataaggaatgagtattggctttacatttaaggctaaaaccagaaaaatagatgcattgaaggaatcggttaaggagatggcggaggaatcgggctacggcctggctctcaatgaaaactggcttacggtgtctttttgtaccatgggagacttgtcaatggaatgggagcgtgaaagcgggctgcgtggacaatggcttattaccggcaattgctgttccacccctgcaggcgccggttttcacgcggcggcagtccggttcctggatgaactggggcagaaacgtctcagtgagcttctggtggatgatgagacagaatattatcatcaccgtgattttgaacgcatgaagcgggaacatttttacccatggctgaatgccctgaagcggcactgcgcggagcggggaagcgggtacagtaatttctgcctctgctgggatatggagcagtatcagcccgaggaagtccccggcacggttataaccccgatgggacgattcaatatagaaaatatgataaagcagacagagaaaaatggcatttcctggctggcggaacgtttttttatctgggacaatgaggaaaaagacgctctttattaccgcaatacggcattgaattatttgtgggagcaatgctgttttgtcccttcacggcgaagctccgaggacagcgtgtgcaatcagatgattatagattctctggagcaggcggccgtactgaatcccgggcttccactgcctgtggacgcgtaccgggagatttgcagtctggcggacagggagccttcgattaaagaagatgcaccaaagatggagtcggattatccggttggtttcagaaagagggaggtaacccactcttttggaacgctccgtcttacactgccggggcggttaaaatatgagtgggaaacgtatggggacggagacggctgcaatatgtggcgggactcggcctcggattcgcctgtatggcgggtcagcggtttcaggctccgttccggaaatgcagaattcccggaggaatgcagtccaaatgatccggaagaatttgaaattccgggcggccgtgcccgtatcggctggattgaatatgaggaggacggacagactgccttccaggccgtttgcgatgttgtatcgggtccctcacagtatctgattacggccgcatatatgcataaagaagaaaaagatggaatctatgctcttatgaggaagctgaaaaccgtgccggataccccggctgtgacaaatacggagagctatgcgcagtgatttgattccgggagataatgtcgaaataaaaggcgaaataaaacagtataagatgccggattataataacggcagaaaggtggtaacaatggaaaaagaagtgttgtggtcggacagaaggcggctctggtgcggtctgccctggacctttaccgtatacagtatgacggaggatcgtctttttatcaagcggggacttttcaatctgagagaagatgaggtgcgtctttaccgtatcaaggatttaggacttgagagaaatctgattcagcgcatgtttggtctgggaacgattcgggttgtttcaagtgattccagccttgggaattttgacctgacgaatgtgaagaacagttcagatgttaaagagcagctgtcgaggctggtggaggaagaaagacagaggaaaaaggtttcttccagagaatttatcagctttgaggaggagaatgaaatggagatttaactgaggttaggaggacgcgtccggaacggaccatgtccggtgtggtgagggggctggctgagtcttccgtccccgggtggaggttgtcgtgaggggggaatccggccggaatggattgctgcggggaccgtttgcactctttggagtgcgaggcagtgctaagctcgtgagggacctcgctaagcaccggcggactcccatgtcccctccgcaattgattccgcctacttccccggggcagattttcgccagggacggaagactcaggcggaggttttcgtggcaccggacatggtccgttccgggcgctgattgtctctaaccttaaatggggaggaccctgtcgcggccactacgtgtttccggcaggccgatatcaaaccttccgcaattctttcataagggcgccttgtaggcatatcgtatttcccgcacacggaagcactgagtggcctcgacaaggtccgccccccgcacttaacgcgtgagacactcagcggccgcaggccggcggacggggccgatacacccggcggagtctttcgttccggcgaaaaccttccgggagaaggagatactgccgacatcttccggcggagaaggagagaatgatatccggaaggacgttcgcccgagagatgatagctcttaggcagagggagacaaagcgcgccgggcggattttagccctacaagggcaaaatccgggacaacttgagcttcgaactcattcggagttcggagcgaatttgtccgtagccccgggggctttgccttcctctgtcttagagctatccctcgaagaagcagtccagccggatatcattctctccggctccgccctgcgaaaacaaaaccacagtatctccttctccagccagcgatgccaaacccccgggacgaaagactcatatacactccccaccaccccgtccgctggccgtaccggcggcgtcctcacctgcttaactaaatctccaataaatgaaaaataatactagtaaacattcttattatctgctataatgtctttaaatataaggaaagttcgatagattacatccaaagtcaattataggaggataaagaatgaatatactgaccgggattttaatcccgtttatcggtaccacggcgggggcagcctgcgtgttttttctaaaggatcagctcaggccggtggtgcagaaaacactgcttggttttgcatccggcgtgatggtggcggcttcggtgtggtcgctgctgataccggctatgaacatgtcggaagggatggggagactcgctttcgttccgtctgcagtcggctttctgtttggcattgcatttttgctgacaatggacaaactgattcctcatctgcacctgaacagcgagaaaccggaaggaactaagagcagtctgcagaagaccacaatgctggttttggctgtgacgcttcataacataccggaaggaatggccgttggtgtcgtatttgcaggcctgctggctgaaaacagcggtgttacgctggcgggtgccctggctttgtcaatcggtatcgcgatacaaaactttccggagggagccattatttcgctgcccctgaaaagcgaaggaggaagcagccgcccgaaggctttctttctcgggatgctctcgggcattgtggagccgataggcgcgctcctgacaatagccatgtaccgtgtcattgtaccggctcttccctatctgctggcctttgcggcaggtgccatgatttatgtcgtcgtcgaggaactgataccggaatcggccgagggagaacactctaatatggggacgattggtttcgccgccggatttgtaattatgatgatcctggatgtggcccttggataacttgtgaagagtaacgtatcagaatcacgcgggcatcataaagtaaagtaagaaaagaaccggaggactgccatggcaacggtcagtctctgtatgatagtaaaaaatgaggaaaaggtgctgggacgctgtctggactctgcaaaagagatagcagacgagataatcattgtagatacaggctccaccgaccgtacaaaggagatagcggcagaatatacagagaaaatctatgatttcaagtggaacgacgatttttccgcagcgagaaacgaatcattcagaaaggcaacgaaggattactgtatgtggctggacgcggatgacgtgataccggaacgcgaacagcaaaagataaagaaactgaaagaacaactgacgccggatgtttccgcggtcatgatgaagtatgtaactgcttttgatgacacaggaaaaccggcgttcctttttgacagggagaggctgcttaagaacggagacggctatttgtggggaggccgcgtgcatgaggcagttgcggtgaggggaaaggtactctattcagatgcggtgattgaacaccactccataaagaaggaatactcagacagaaatttaagaatctatgaaagaatgatagaagagggggaagaactcgaaccgcgccaccagttttattacggccgtgagctttattatcacgggaggaatgaggatgcggtcagaatctttgaaacttttcttagggaccgggaaaagggggcctggcttgaaaatctggtagatgcctgccggttctgcgcactgtgcttttacaggatggggaaaagggaggaggcgcttgaaaagctgttttggacgttctcttatgatgtgccgcggcctcagatatgctgcgatatcggaaaacatttcctggatgaaaatcgcttaaaggaggcggagttctggtaccgtcaggcaatgcagacatcgtatgaaccaatccccggggcttttgtggaaccggagtacagagagtttattccggcaatacaactggctgtctgcctggatcgtcaggggaaatacgtggaggcagccagatataatgaacttgcttcctattacaaaccggattcggaggcagtcaaacagaaccgcatatattttgaaggcttgaaataatttcaggggtttcattcaaagcacatatgataaggtgtttttttccgtttctgttcacaccataccgcttcctagcgaggtgtgaacagtaaccaaattttctccggaagataccttgctgaacagctatcttgcaaaacacatttttttatgtaataataaaacagattatataccagatctggaggaataatatggcaaaaacacagtatgatgcggacagtattaccgtcctggaaggcctggaggcggtccgcaaacgccccggtatgtatatcggaggtgtgggaacaaaaggcctcaatcatttaatatacgagatcgtggataactcggtcgatgaacatctggccggggagtgcaacgacatctgggtaacgctggaagcggacggctcctgtaccgtccgcgacaacggcaggggaatcccggtggagatgcataaaaagggggtctcggcagagagaattgtactctctaccctgcacgcaggagggaaattcgacaataatgcttacaagacaagcggcggtcttcacggagtaggttcttccgtggtgaacgccctttccgagcatatggatgtgacggtctataagaacggccagatccaccatgacgcatatgagagagggatcccgaccgtaaagctggtggacggactgcttccggtgataggaaagaccagggagacaggtacgaagattaattttatgcccgacggagagatctttgaaaagacgcgttttaaggcggaatggctcaagagccgtctccatgagacagcctacctcaatcccagactttccatccattacgagaacaaaagagcgggagaagcggagaaaatcacatacagcgagccggaagggatactggcctatgtgaaggagctcaacagcacgaagacgccggtccatgagccgttttattttaaagggacatcagagaatatcgaagtggaggtagcattccagttcgtcgataccttcgaggaaaatgtactcggcttctgtaacaatatttttacacaggagggcggaacccaccttgtcggcttcaagacccgcttcacaaccatgatcaacagctatgcccgggagcttggaatcctgaaggagaaggattccaactttacgggtgcggacacgagaaacggaatgacggccgtgattgcggtaaaacaccctgatccgatttttgaaggccagacaaagacaaagctggccagcgccgactgcacgaaagctgtctttaatgtgacgggcgaggagttacagctttattttgaccggaacgtcgaggtcctaaaggcggtgatcgcctgtgcggaaaaatctgctaaaatcaggaaggcggaggaaaaagccaagacaaatatgctgacaaagtcgaaattttcctttgacagcaacggcaagctggccaattgcgaaagccgggatgcggagaaatgcgaaattttcatcgtcgagggagattcggccggcggttccgccaagatgggaagaaaccggcagtaccaggccatccttccgatccgcggaaagattctgaacgtggagaaagccacaatggacaaggttctggccaacgctgagattaagacgatgatcaacaccttcggctgcggcttttccgaaggatacggcaatgacttcgatatcacgaagctccgctataataaaatcatactgatgacggatgccgatgtggacggcagccatattgatacgctgcttctcaccttcctgtaccgttttatgcccgagcttatcagcaacggacatgtttatatcgcaatgcccccgctgtttaaggtaatcccgaagaagggcaaggaagagtacctctacgatgagaaagccctggagaggtacagaaagaaccataccggtgatttcaccctccagagatacaagggtcttggagagatggatgcggaacagctctgggagacgaccttaaatccggagaaccggattttgaagcgggtggagatcgaggatgccaggatggcttcggagattacggagatgctgatgggaagcgaagtgccgcccagacgccagtttatctatgagcatgccgatgaggcggagatagatgcataagcatcctgcgggaagctgcgccttacgatacccggcgcatgaaaacgcctcacaaaatattacccgcggcaggaaacaagtcagaaacttaagattgcaggagatagaataaagaatggctgagaaaattatcacaacggaatactcggaagagatgcagcgcagttacatgaattattccatgagcgtcattacggccagggcgattcccgatgccagggacggccttaaacccgtgcagcgccgtgtgctttatgatatgagcgagctgcgcctcggttccgacaagccccacagaaagtcggcccgtattgtcggcgatacgatgggtaaatatcatccccacggagacagttccatctatgagacgctggtcgtcatgtcccaggtcttcaagaaaggaatgcctctcgtaaacgggcacggaaacttcggttccattgagggggacggggctgccgccatgcggtacacggaagcaaggcttgagaaatttgcggaggaagtctatttaaaggatttggacaagaccgtaccgtttgtcccgaattatgatgagacggagaaggagccggaggttcttccggtccgcgtgcccaacctgctgatcaacggcgcggagggaattgcggtaggaatgagtaccagcattccgccccacaatctgggggaggtcgtggatacggttatggcttatatcgataatccggaatgcacgacaaaagaattgctcgatatactccatggccctgatttcccgacaggcgggattatcgccaacaagagcgatctgctgaatatttatgagacgggaagcggacggatcaagctgcgcgccaagctggaggtggaattaggcaagcggcgtgtggacaaggacaagctgatcatatcggagattccttacacgatgataggtgcaggcattaataaatgtcttgtcgatattgcggatttggtggagtcgaagaaactcaccgatgtggtggatatctcgaaccagtccaacaaagagggaatccgcattgttctggaattaaagaaagatgccgatatcgaaaagattaaaaatatcctttataaaaaaacgaagctggaggataccttcggcgtcaatatgctggcaattgccggcggccgcccggagactcttacgttaaaaggaattcttaaaaattacctggatttccagtatgagaataatacacgcaaatacaatgtgcttctggaaaaagagctggaaaagaaggagatccgggaaggtttaatcaaggcctgtgatgtgattgacctgattatcgccatactcagaggttccaaaaatttaaaggacgcgaaggcctgcctgatggagggagatatttccaacatccatttcaagacgccgggctttgacgaggacgccaggaagctgcgcttcacggaaaagcaggcgtccgcgattctggagatgcgtctctataagctgattggacttgaaattctggccctggagaaggaatataaggaaactctgaggaaaataaaggaatacgaaaagatcctgtccagcaagctgaccatggacgatgtgatcaagaaagacctggaagagattaaagcggaatttgccacgccgaggagaacgctgattgaggacggcaaggaggctgtctatgatgagacggcggttgagatccgggaggtcgtctttgtcatggacaagtttggttacggcaagctggtggacagggcgacctacgacagaaaccaggagacgatagaaggggagaatccccatgtcatcccctgcctgaataccgataaaatctgtctctttacggacacgggacttcttcaccaggtgaaggcttctgatattccatttgggaaaatgagggataaaggaacaccggtcgataacctctgtaaatttgacgggacaaaggaacgcccgatattcattatcaatgcttcggccctggtgggacgccgtctgctgtttgcaacaaagggagctatggtcaaactggttccgggtgaagaatttgagacaaataacaggatggttgccgctacaaagctccaggacggcgacatggttgtcagcatccagctgacagacggcaggacggaggccgttctccagacgacaaacggcgtattcctccgctttgatctggaagaaatttccacactcaagaagaattccaagggcgtcaggggaattaagctgggccgcggagaagaactggaacaggtttatctgctgggtacagacagtgagcagaccgttatgtacaaagaaaaacaggtgcatctgaaccgtctgaagataggaaagagagacgggaaagggagtaaagtgcggctttaaaaccgccttggcagagttactgttcacaccatgccaaaaagcggcatgatgtaaacaataacacgcttcgcgatgcacagaaactgcacaaaacgcagtttcgcgccgtgtaactcgggattttcgcgcagaaaacgcacgaaaacacctcgcgggacataaccgtgtgaacagtaacttggcagataccggggctgatgcggtaattgactttttttcataatcatgataaatttattaaataatatagttaatacatttgttggcttctgccggaaagtgacagaatggataaacatgatatttatataaaaattgagaatgaaattcagaagaataaagatggattgacagagctgggacgggagctgtttaatcacccggagcctggttttaaagaagtggaatcgaataagattctcacttcttttttgcgtgagaatggaatttcctgccgctccgatatctgtctgacagggattcgggcggagattgggaatggggaaggataccacattgcgctggtggcggatatggacgcgctgattgtggacgacggggagaagcgttacccctaccattcctgcggacacagcatccaaaccgccgtcatggcctatgtgctgaaaatgttgaatgatatgaagctctgcggggagacgggaggacgggtcaccttcatcgccgcgcctgccgaggagtttattgagtttgaatacaggcagaagctgagagcggaagggaagattaagtatttctccggaaagcagaacatgatagaacaggggatatttgacgatgtggactgcgtgatttccatgcatgtgaacggggagaccggcacattgttcgacgttggctccacattggccggattcatggtgaaaaaggctgtttttaccggagccgccgctcattccggagctgccgcccatatgggaaaaaatgcgctccatggggccagtctctgcatggatgccattgcctatatgaaagatcagtttcccaaggaggccggactccagatccatccggttatcacacagtgtggaggcagcgtcaatattattcccgataaggcggttctcgagagctatatcagggcaaatacgctggaggagcttttggaggcaggagagaagtttgacctctgtgccgtccactctgccggggccttaggtcttggctgccggattgaaaaccagacgggatatatgccgcttcagcagtcaagtgaaataaacgaaatcatttaccgccatatgcgggagatttgcccggacgacaggattgtgaagaatgtggtttcgggggcgtccggcgatgtcggggatttaggttatctgcttccgacggtgcagtttggattttcagggataaagggccggattcacagcagcgaatttgagattacagatgaagagaatgtctatctccacacagctaagatagtcatgaaaacagtatatgatttgctgtcctgtccgcagcttcaggttaaaaataaagatttttctgaaagaaaagagttttatttgaaaaactggttatacaaagaacaggagtaacagttcatgttgcctaaactgttatgaacagtagcattaatccggaaaaaacggcgttcagaatatcagcttacggcagaccggacagtaagggcgggaccgtttcatctgaaacgcgttttctacaataaatatgattatattctaaatatcaggaggaagtgactatgtcagaacacaacataccaacaccgcatattgcggcacaggcaggagaaattgcggagacaatccttttaccgggagatccgcttcgggcaaaatatattgcagataattttctgaccgatgttaaacagtttaatgcaaccagaaatatgtttggttacacaggctcttataaggggaaacgcgtatcagtcatgggaacgggaatggggtgtccgtctatcggcatctattcctatgagctgattcatttttacggatgcaagaacctgatccgtgtcggcacggcgggcgcgctccgtccggaggtgaaggtccgcgacatggtattcggcatgggagcctgcactacatccaattttgtgaaacagttccgccttccgggcgattattcctgcatctgcagctacgagcttcttgcaaaagcggtaaaagcagcggaggagaaaggacttcattatcacgtcggcaatatcttaagctcagatatgttctataatccggagcttcctccggtgggaaccacctgggataagatgggtgttctggcggtagagatggaggctgcggccctttacagcaacgcggcatacgcaggcgtcaacgctctctgtatcctgactgtctcagattccgcggtgacaggcgaggctacgaccgccgaggagcggcagacctcatttaccaacatgatggaagttgctctggaacttgcataagtgatattaggagtgccggacagacggcggcactttacagcgaaagaataaggggaatgactatggcagaggaaattttacgggtggaagacctgactaaaatttatccgggcggcgttctggccaactataatattaatttcagcgtagacaaaggagaaatccatgcgctggtaggtgaaaacggagccggaaagtccactctgatgaagatgctgtttggaattgaggaaattacaagcggcaaagtattccttcatggacaggaaatgcattttcattccagtaaggatgcaatcgaacacggaatcggaatggtccatcagcatatgatgctggtgccttcgctgaccgttgcggagaatctggtactgggaatcgagcagaaaaagggaatgttcctggatcagaagaaagcagtggaagagacagagaaaatttcaaagaaatataatcttcatgtggatgccacaaggagagtccgtgacatctccatcggtatgaagcagaagctggagatattaaaaaccatgtaccgcggggcaaagattataatcctggacgagccgaccgccgttctggcgccgcaggagacggaggaactgtttgaacagcttctgaacctcaagaaagaaggctatacgatcattttcatctcccataagctccatgaggtcaaatatctctgtgacaggctgaccgtgcttaaggacggccggtccatcggaacttataaggtggaggatgtgacgccggaagaaatttcacgcctgatggtggggcgcgacgtcaaactggagtatgataagacgccgcagcaattcggcaataagatattgacggtggaaaacctgtgctataccgataaattcggcacgaaaaaactggacaacctgaatttctccctgaaacagggagaagtgctgggaattgccggtatcgaaggcaacggccagaaagaggccatggagatcctgaccggcaatatgaaggcggagagcggcgccattcattaccgcggggaagatctctgccgtaagactatccgggaaaacagaaggatgggaatcgcccatgtgccggaagaccgcaacttaaacggcagcgcgccggagatgagcgtgcgtgataacttaattgccgcaagtctcgacaagctgtccaaaggaacgattctcgacaggaaagcgattgaggactattgcgaggcctgtgtcgaagacttcagggttaagacatccagcctcaatatcagcatcaagagcctctcgggaggaaatatccagaaggccattgtggccagggaatttacggcaggcgccgacatcatcatcctgaaccagccgacacggggcgtggacgtcggagccatggagtttattcacaagaagatactggaaatgcgggatgaaaagaaatccctgattttagtaagcgccgacctggcagagttaaaggcactgagcgatcgcattattgtattccatcagggaacgattgcgggcgtccttgacgatgtccccaatacgacggaagaagaacttggtttatatatgctgggacttaagtctgattccgaagagaagcttaaggaggcgtaagatgaacaggaagaaaaagtttgaatggtatggagtgatccgcgtgacggcggccattctgatcgctcttctgattgcggcggcgattatttttgcagtggcggacgatcccgggacagcgctttacagattcctgctgggaccattttcgacaaaaagaaacttctttaatgtaattgaaacaatgataccgctggtattctgcggacttgccatcaacgtcatgcataagagcggcctgttctccatggtggccgacagctccttctattttgcgggcgtcatggcggcgacgctggcaatcgcatgtccgatgccgaatatcctgcatcagatcgtaatcctggctgttgccatggcagtgggaggcgtgattggcattattccggttctgattaagagaaagacgggagccaacgaactcgttatctctctgatgatgaactatatcttctttaatttcggttactggctgatccggaaatttttcctggatacgtccaacggctcgttctccatcggtttccagccgacggcgacactgggcaagatgctgaaagggaccaatacacactatggtctgctcatcatgatcgctgctgtcattatcatgtggattctgatggataaatcgaaattcggccgtgaactgaaaattacaggctccaatgaaaactttgcaaaatatgcaggtatcaagattggcggagtcgtaatcggctcccagttaatcggcggaatgctggccggacttggcggcggcgtcgagatgatcggcatgtacaaaaagttccagtggattacggctcagacgtacgtatgggacggtattctgatcaacctgctggcaggcacaaagccgcttatgattccggtttccgcctttttcatttcctatatccgaatcggcgcccttgtaatgtccagaggcggggatgtggactcagagattgtatccatcatccagggcatcatgatcatgctgattgcctccgaacggttcctgtataagatgaagaagaataaagaagaaagagaagcgctgcagaaccagacggtggaagcagaaggcgcgaactaaggagggggaaaaatggactttttaacaaatcttgatttttggtttaccgttctccgagctacgacgccggttctctttgccacgatggctgcgctcatcgccagccgttccggcatgctcaacctgggactggaaggagcgatgacaattgcagcgctctgcggagtattgggaagcggctttaccgggagccttcttgtcggcgctgtctgcggccttgcggccggaatcggttttaccatgcttctggcctactttgtccagcaccttaaggcaaatcaggtaatctccggtgtggccctcaatctggcggccagcgggggctctgttttctgcctgtattccataacgggagacaagaatgccagcaactctctggcttcgtcggcattcccggccgtacagattccggtcattaaggatataccgggtctgggagatgtattatccggacataacagtttgacttatgtcgcatttattgttacaatcgtcatgttcattatgctgaaaaagacgtccttcggcgttcatatcagggccgtgggcgagtcggaggaggcagcacgctccgtcggtatcaatgtgaaacgtgtgcgttaccaggctatgctgatcagcggcactctggcatcccttggcggaatgtatctgtccatgggatatgtgaaccgttttacatcaggcatggtggcgggacgcggctatattgcacttgcaaccaacgcgatggcggccggcaatgcgctgatgggaatggtcagctctatcctgtacggtttcggcagcggtatctccatctatcttcagaataacaatgtggatccgtacctgattacaattattccatacgcatccatcattatcttctatgttttgttcagcctttattacaaggtcaggagaaagacggaggattccctgtaggcgcagaaaagcccgattacggaagaaggaatttcctgttttaactatcgttcgttatctcttgggagctgtctccctttagatatagaaaaccatttatttatacgatctaaggaggaacattatgagaaaatcattcaaaaaagcagcagccatcgttctgactgcggctatggcattgtccatgactgcatgcggcggcggcaaagcggcggaagagacaaaagcggaagcaggcagtgaagctgcagagccggcagcagacggcgagacaaaagcggcagagaatgcaggcagcggcgagaaactgaaaatgacactctgcatcggccgtaagaacgacctttccttccagcagtcagcctatgaaggcgccatgagagtgcaggaggagatgggcgacaagtttgaagtcaatgtggttgagatgggcgacgacacgaccaagtggcaggcagctttctacgacgcggcggacagcggcgcggacatcattgttggaaccggtttccagaacaaagagaactttgagacaatcccgttagagtatccggataccaagttcatcctctttgaccaggatgttgactacagctcaggcgatttgggcaacgttttaaccgtattatttgattccaaccagtccggtttccttgcaggcgctgttgcggcatactacacaacaggcgagaacgctgccaacaccgataagacaatcggtttcgtaggcggaacggagagcacgacggttaacaacttccttgtaggttatgcagagggcgctaaatatgtggaccctgagacaaagatcctgacagcttatgtaggcgacttcatggatacggccaaggcaaaggatcttgccaacgcacagatttccgaaggcgccgacatcgttttccaggttgcaggcggtgcaggcaacggtgtaatcgaagctgcggctgagaaagacggcgtgatggctatcggtgtggacagtgatcagtacagaaccctggaaggctccaacttacaggcatccgttattacatccagcttaaagcttcttgacaacgcattatttaaaatctgctccgactatgtggaagatccttccaaggtaccgttcggaacgaccgtaacttacggccttaaggacaacgccgtaggtatcgtgttcaacgagaacctgacaaagagcattggtgaggagaatgtcgccaaagttaaggagattctcggaaagattcagagcggagagattaccgtatccgatgcggctgaattgacggcagatcagattaaagagattgtaaacaactaagaagaagctgctgcatcccggaggcgcattaaacggccggggtgcggctttttctatattcagacggaaggatggcggcattttgaggggaatcatagacagccacgcccacatctgcggcgatatcctgtatcccaggtgggaagaggtgattgccggagctaaggaagcggggattgaaaaaataatgattgtctgcacaggactttccgaggcggagagagcgattgagattgcaaagaaggaatcgatgtttgacgtcgcctgtgcattttatccaaatgacatactgaaggtaacagataaagattttatacggctggaggagctggttaagcgtccgcaggtgaaagcggtgggcgagattgggatggactattttccctatgagaagacagttccggccgatatacagagagacgctttcatcagacagattgagatggctaataacgtaaacaagccggtgttaatccatatgcggcttgcaacgaaagatacatgccgctatatgaaggaacatttaagggtgccgggaatcatgcactgctacagcggcggctttgaggcaatgcaggaatttctcgacatgggcatgtatatttctttttcgggaaatattacttttgaaccggatgatatcagcacacagagagctgtcagggaagttccgcttgaccggattctggtagaaaccgatgcaccctcccttacgcctgccccgatgcagggaagagataatgaaccgaaatatataacttatgtgatagagcatatctgccgggtgagaaatatcgaaaaagaagacctgatccgggcggcaggagagaactacagacgtctgatgggagaataaaatggaatttaatcatatggaataccgttatccctcacgccgtgaagctatatttgcgaagaacgggatggtatgcaccagccagccgcttgcggcccaggccggactggacatattaaaacagggcggcaacgcagtcgatgcggctgttgccacggcggcagccatgacggtgctggagccgacttccaacggaatcggcggagatgccttcgcgcttgtatggctggaacggaaaaaagaactgctcggattaaacgcaagtggtaaaacgccgcgtttgattaatgcggataaagtgaggaaatcgggctgcaaggagatgccggttcgcggatggctgccggtcatggtgccgggagcgccgtccgcatgggcagagatgaccgaaaaatacggctgcctaactttggaggagaacctggagccggctatccgctatgcaaaagaaggctatccggtaacgcccgtcatagccggactttggaatgcggcatttgagctgtttggcaaaatccgccgtgaggaacaggatacggactggctggaaccatggtttcatcattttgccccggaaggccatgccccgaaggcaggtgaaatttggaaatccggggatatggaggagacgctgaaaaagattgccggaaccggcgcccgtgatttttacataggggagctggcctgcaaaatcgatgagttttcccgcaggaccggcggatatctgagaaaagaagatctggaaggctattggtgtgaatgggtaaaaccaattcatattggctaccgggattatgaggtatgggaaataccgccgaacggggatggaattatcgccctgatggcgcttaatatattaaagaactttgaatttgagtcggacggcagggaaagcgccgaaacctgccacaggcagctggaggcaatgaagctggcctttgccgacggcacgcggtatgtggcagacacgaagtccatgacagtgactgccgcagagctgttaagcggcagctatggacgaatgcgaagccgtctcattggcaagactgccggaacgccaaacgcaggagatccgagaagcggaggcaccatttatctttgcacggccgaccgggaggggaatatggtttcctttatccagagcaattttaacggattcggctccggcgtcgtcgtgccggggacgggaatatcccttcagaacagggggtgtgccttcactctggatggaaaatcagagaactgcctgggaccggaaaagaaagcgtttcatacgataattccgggtttcctgacaaaaggcggggaggcggtaggaccttttggcgtcatgggagcattcatgcagccccagggccatgtccaggttctgatgaatatgatagactttaagctgaatccgcaggaagctctggacgcaccgagatggcagtggattaaagataaaaaggtgcaggtggagccgctgtttccgaaagaactggcgaagcagctctcagccagaggccacgaggtggaggcggtggagagtgcggtaagcttcggccggggtgagatgatactgaaagacaaaaacggcgtttactgcggtgcggctgagccgagggcaggcggccatgtggcggcttggtaaatcagaaacttacgcaatgatttgagaaggagatagaacgatgattaaactggaacccaaaaataaaaaagcgcttttaaaaacggccctggggctggaaccggccgatctggcaatcaataactgccgtctggtcaatgtatttacaggggagatttatccggctgtcgtatatgtaaaagatggatttatcgctcatgtggagacggagaagctggaagggccgtatggtgcccttgaaatttacgacggagaaggacggtacctgatcccgggcctcatcgattcccatatgcatatcgaaagctcgatgatgacgcccaggaattttgccagagtcgtcattcctcacggaactactacaataatccatgatccccatgagcttgccaatgtttacggtgtggatgctgttaaatacatgcatgacagtgcggacgatcttccgatgcgccagcttgtggacattccgagctgtgttccggctgtgccgggctgcgaaaatgccggagccgagttttttgccggggagatccgtgagctggcaaagcttaagcgcgtggtcggccttgccgaggtgatggatttttacggagtgatgaacggtgacgaacggatgatggatattatcgaagcggcacaggagagcggcctttacctccagggccatgccccggggctgggcggcaggcagctttccgcttatctgtgcggcggtccgaatacctgccatgagacgaccaatggggaggaagctctcggtaagctgagggcaggcatgtatgtggatgcaagggaaagctccatcacaaagaacgtgaaagcaattgtggaggggattcagggaattcgcttctatgatacgctgaccctttgcagcgacgacagagagagtgacgatctgcttcatacgggccatctgaatgccgtggtcagaaaagcgattgagtgcggcatggaccctgtgctggcgatcaagagcgccacgatcaatacggccagggaaatcggcgtgagccatataggcgcagtagcgcccggatacaccgcggatatggtgctgacaaaagacatccatacgatgtgggccgacgccgtattctacggcggaaagctggttgcagagcatggaaaactgacggtggaaatcgaagaccgcgagtatgagatggagacaagaaattccatgaatgcggggaatgtgtcactggatgactttatcgtaaaagcacctgtggaaaatggtacggtgaaagtccatgtaatggagtaccacgatcttctccagagcatgacaagatgcgcggtggaagagctggaggtgaaggacaataaggtagtcctgggagagggaatggcctttgtagccgtcatcaaccgacatggaaaagggacaaaggctctgggaattgtcaaaaatttcggcagcagcgaaggcgccatcgcctccaccgtttcccatgactcccacaatctaaccatcgtctacttcaaaccggaggatgcactggctgccgcaaaggaactgattgcaaaaggcggaggcatgacggcggtaaaggacggcgtcgttctgaacacgctccgtctggaagtgggcggcctgatgaccaggctgaatgcggaggaactgacaaaagaagcagcgagaatgaaggaagtagagcgcggtctgggtctgactgcccaggaaaatcctcttcttcgcattgtttccctggcgcttccggttattcctgatgtaaaaatgtcggatttgggactcgtttccgtcgcggaacagaagattattccgttgttcacgtcataaattgtatgaatgtgcgcgcaagaaagacaaatgtattttctttgcggaaaaatattgatttttttaaagaattggtttaggatatacgttaatgctgcttatgtataacagttccggacagcttacggaactgtaaaacggcagcgcgcaggaatgcggcaatcccacgggcgtcccgaaccgggcggcaatatagggaaatagaaatccgggaatgaggagaatagagatggaaatgaagaagaaattacgtgtaggcgtcttaggtgcaactggtatggtaggacagcgttttattacgcttctggcagagcatccctggtatgaggttaccgcagtggcggcaagccccagatccgctgggagaacctatgaggaggcggtgggaggacgctggaagatgcagactccgatgccggaatccgttaagaacatggtagttatgaatgtcaacgaggtggagaaggtagccgaagccgttgatttcgtcttcagcgccgtcgatatgacgaaggaagagatcagagccattgaggacgcctatgcaaaggcggaaattccggtggtttccaataacagcgcccaccgctggacgccggatgttccgatggtggttccggagattaacccggaacactttggcgtaatcgaattccagaaaaagcgtcttggaacgacgagaggctttgttgctgtaaagccgaactgctcgattcaaagctatgctcctgttttaactgcgtggaaggaatttgaaccttatgaagtagtggctactacgtaccaggctatctccggtgcgggcaagacatttggtgactggccggaaatggtggagaatataattccgtatatcggcggtgaagaggaaaagagtgagcaggagccgttaagactctggggcgaaataaaagacggacagattgtaaaggcagaaggcccgttaatcacatgccagtgtatccgtgtgccggtattggacggacatacggccgccgtttttgtaaaattcaaaaagaacccgacgaaagaagagcttattgagaagcttgtgaatttcaaagggcttcctcaggagctggggctaccgagtgcgccgaagcagtttatccagtatctggaagaagataaccgtccccaggtaaaattggatgtgaattatgagaagggaatgggagtttccgtaggccggctgagagaagatacggtttacgactggaaattcgttggactgtcccataacacgctgagaggcgcggcaggcggagccgttctgtgtgcagagcttctgacggcccagggatatattcaggctaaataaggccggggactgaacggtaacactgtgaatagtaacaacagttttcatccggttaaggaggaatatattttatgtataaaaaggtaaagtttggtgaattggaagacggaagagaggtctttcagtataccctgacgaatcggaacggagtaacggcgtcttttctggatctgggcggaatttggtcgtccatgcttgtcccggatgccaacggccggctggacgacgtggtgctgggatatgacacgatcgaagcatgtctggtcaacggcggccatctgggcgagattgttggaagaaatgcaaacaggataggcagggcggaatttacgctgaatggcgttacatataaactggctgccaacaacggcccgaataatctgcacagcggtcctgacttctatcgtgacagaatatgggacactgagttatccgaaggggaaggggagagttccattacattttctcttataagtcccgacggagatcaggggtatcccggcaatgcaaggatttccgtcgtctataccctgactgatgagaacgaactgaaaatcaggtaccatatgatttgtgacagggacaccgtcgcaaatatgacgaatcacagctattttaatctggccggacataatagcggcagcgcggtgaatcagcttgtgtggattgatgcggactgctttacaccgacagatgaggtgtccatcccatacggcagaatcagcccggttaaagatacgccgatggactttacgtccggaaagccgattggccgcgatattgatgaggattatgagcagcttaaatacggccatggctatgaccataactgggttctgaaccatgagcctggaaaactggctctttcggcaaaggcctgggacgaagccagcggccgtgtgatggaggtctatacggacctgccgggaatccagttttatacggccaattatctggagccggagataccgggcaaagagggcgtgatgtacggtccgcgccacggatactgttttgagacacagtattacccgaatgccatcaatactcctgattttccttccccggttttaaaggaaggaaaagaatataatactaccactatttacaaatttatgatagaataattaaatgtgagaagatggtaacagttcagactggtctgcgcatttgctgcgctgaccgtgcaaaaaagcagtggcagcaggcagccggctcatcgcgcagcgattttaattagccgaatgccgtaacggttcacgctgtcttaactgttacggaaaatggatacagggatgcagaaaaaagccttcggcaaaagctgcagccctgtatttttggtaacagttcagccatgatgcgttccgtgaggtgatttcgctgtttatcgcaaaatcccgggttttgcagcgcggagcggtggcaggccggggatatgaggtcttgaagagccgggagggtgaaatcgaaatggaagcgacaaagggaaaaatgaatgataaaacagtaaagctgcttgcgtcggccgggcttttactggtgacaattgtatggggaagcgcatttgtggtgatgaagaattccatggatgtgataaaacccacgtatcttttggcatacaggtttacgatcgccacggcaggccttattcttatattccggaagcaggtcaaatcaatgacatgggccgatatcaaatgcggcgccctgctggggattttcctgtttatcagctattatttccagacttatgggctgaagtttacgacggccagtaaaaatgcatttatcacaacgctgtacgtgatcatcgtgccgtttctgcactggttttttaacaaggtaaaaccgtcgggaaataatataacggcggcctgtattgcagtagtcgggctggcgctcctttccctgaaaggagatctgaccgttaatttcggagatttcctgacattcatctgcggcttttgttttgcccttcatatggtgtttatcgaccgctatacaatgtgttacagtcctatcaagctgacggttgtgcagatggcctcctgtgccgtattcgcctggctggtggcggcagtttttgaaggtccatgtgatctgagtgcctttacagaccggggaaccgtcgtatccgtcctgtaccttggcgtcatatcaagtatgctctgttttctccttcagacggtggggcagacgtatctcagcgcaagcacctcatcgatactgctgtcgtttgaatctgtattcggccttatcttctccgtcatcttcctgcaggagtcggttacggccaggatgctgctgggatgcgccctgatgtttgccgcagccattttagccgagcgcacgccgtctcagaagaaaaaggccaaaaaaaggaagagtgaagaaacggctgaagtctgatattattactatattaaaacagaatgtggggaactgaatggcaaaatcattatacatagcagaaaaaccgagtgtggccagagaatttgccgcagcccttaagattgcgggcagggcggcggacggctatattgaatcggagaatgcagtcgtaacctggtgtgtgggacatctcgttaccatgagttatccggaggcatacgacataaaatataagaggtggagtctccagacacttccttttcttccgaaagaatttaaatatcaggtgattgagagcgttgaaaagcagtttaaaatcgttagcgggcttctgaaccggaaagatgtggatacaatctatgtctgtaccgactccgggcgggagggtgagtacatttaccgcctggtggcgcagatggccgggattaaagataaagcacagaaaagggtctggattgactcccagaccgaggaggagattctccgcgggatacgggaggccaaggacctggaggagtatgataatctggcttcctcggcttatctgagggccaaggaagattatctgatgggaattaatttttccagggcgctcacgttaaaatacggcccctcgatttcaaattttatgcggacggacaggacggtggtctccgtcggccgcgttatgacatgcgttatggggatggcggtgcgccgggaaagagaaatcagagaatttgtaaaaaccccattctaccgcgtgataggaaccttcggaccggatgggattactatagacggtgagtggaaggccgtggagggatccagatattttaaccatccctgcctttataaagaaaacggtttcaaagagagaaaggatgcggaggagctgatagcctttctctcctctgccgagccgcgaaacggcactatcgcctcgattgagaagaagaaggagacgaaaaatccgcctcttttatacaacctggcagagcttcagaacgactgctccaggatgtttaagataagcccggaccagacgcttaaggctgttcaggagctttatgaaaaaaaacttgttacctatccgagaacggatgccagggtactttccacggcggtggcaaaggaaattcataagaatatcggcggcctgcaaaatttcggcccggcggccgaatatgccagagaggtgctggcctcgggctcttacaagactattgtaaagacgagatacgtcaatgataagcagataaccgatcactatgctattgtacccaccggacagggactgggcgctctcaggagcctgtcggagctgaattcaaagatataccaggtgattgtcagaagattcttaagtattttttatcctccggcaatttaccagaagtatacggtggacattgtcacacagaacgagcatttttttgccggattcaaggtactcagggagcagggctatctgaaggtggccgaggtgccgggtcagggccggaaaaagaatacaggcgctccggatgccggctcggacggcaatgtacttcctgccgagaagccgggagcggccggggatgtgattctggattcatccagtccggaatttattgaaatgctggataaactgaaaaagggtgcggtcgtttccctggatgccctgaatataaaagagggtgaaacgtcgcctccaaaacgatacacctccggttccatgattctggcgatggagaatgccggacagctgattgaagatgaagagctccgcgcacagatcaagggaagcgggatcggcaccagcgcaaccagagccgagattttaaagaagctatttaacatcaagtacttgtcactgaataacaagacacagataattacgccaacttgtctgggagaattgatttacgaggtggttaacgcttccattaagcagctgttaaatccggagctgaccgccagctgggagaaggggcttacctatgttgcagaaggcagcatcacttccgatgaatatatggaaaagctggagcggtttgtggccggccggacttataatgcggttcatatggcgaaccagtcagggctccgcccgctgtttgagcaggtagccgtcaattataaaccttccggagcggggaaaaaggcggaggggaagtccgcaggaaaaaatgaagcaaagacagagccgtcacaaaaatgacggaagacagaaagagaggagcaacattatgaaccgggaacagatgaggattacggagctttatgatttgacacatacacttgcagcagattatctttcaggatttgagtatccctgggacgcgcttcagggaatcagcgattttataattgctctgggcaacagcctggatacggaagaatacgaaaaaagagacggcaatgtgtgggtccataagaccgcaaaggtcgcttcgtccgcgtttctgaacgggcctgttattgtgggcagggaagccgaggtgcgccactgtgcctttatccgcggcagcgctctgattggagaaggagctgtggtaggcaattccacagagcttaagaatgtgattctttttgataaggtgcaagtgccgcactacaattatgtcggggattcgattttgggctataaagctcatatgggagccggttccatcacctcaaatgtgaaatcggataaactgcttgtcagtatccatgctgcggacggagagattgagagcggacgcaagaaagtcggagccctgattggcgacaatgtggaggtaggctgcggctctgtcctgaatccgggcactgtaattgggcgaaattccaatatctatcccctttccagtgtgcgcggctgtgtggacgccaattccatctacaaaaggcagggagagatagcagggaaaaattaattatgcaggtgaggacgctgccggaactgccggcccgatcatcacaccggacatggtccgttccggacgcgtcctccattctcaattaccccatgtatttttaaaaggcatgatcattccgtcaaattatgctatgataaaatcagagagaatcaactccgcctgtatagttatacaataaggcggcaatccattagctatgttttaggaataaataattaatggataaggagaccagctatgaaaagtcaagtataaattaggcgaaaattcatttttctaatcgatggtaaagaagggtaactctaataaagctccctaacggtgctttttcaaaatctatcgatattggtatgcagacctcttattcgaggttaaattccacttcgtcagtgagcatcttccatatgaccctgacaagtttgccggcacagtgcccaagggcattatagtgagtccggccttcggctctcttggcatcgtagtaagctttgaaagtcgcattgttctttacgacattatgtgctgcatttacgagagcgtaacgaagaacacgcgagcctcgtttggacatccgggtcttcttggcctggaagttaccagactgataaacagacggatccaatccggcaaatgcaagcaatttgcccggtgtagggaagcgatggatatcgccaatctcaccaagtatcatcccgccattggtagtcccaatgcccgggatggtcatgatcacagagtggaggcaggtgacaaggtttgccatttcaagctctgtatggaataactggctatccaataactcaatctgttcaatggtctgagttatttgaatagataaggaactgtcatggataccgacagacttctgtgcgagaattcttaatcctctggccgtatctttaccaaaatgaccgtgggaagccgtttggagaagatgagtgagatgagtcatatgcatagaagcaatatcattcggtgtcggcgcttctttaaggagcgtatagacagaattctgatgcacaccggacttaaagaagtgctgtagttccgggaagacctgatccatgtaggaagtcagctgtatttttaaacgggtgcgctgcttcacggttttctgtcggaatctgccgagttccttgagttcgatgtaatccagatcctttaaggagatgaaccttaaaggatcctgcaacataagggttttagcaataacaaatgtgtcgactttgtcggtcttcgtcttgcgtacattatttttacgcatagccgaagtcgataagggattgagaacacacactttaaaatccttgcttatcaaaaaacggacaaggttgtcaccgtagtgtgccgttgattcaagaccaatgatgatgctgtcctggtcaagtggtgccagtttagaaagcagcagatagaagccatcatagtcatttgagaatttgaacggctcgatgagtatcccgccctccgaagaaatggcagcggcgaaatggttgagtttggcaatatcaatgcctacgtaaatcatgaggttgtacctccctttcataaagtccgataccgtgatatccaccaacgattatcatcgtagacttgattgaaataagtactcagagtgaaacactccggcaacatccagctataaacaattcagataaaagtagcggcaatacactcctgttgagtagtcaagctacaggataaaatcaaaagtccacagtatctgaatgtattaaaccacagttcaagaaaaatgaaaggaatatgttgtttttgcttctataaacatcatacaaggatattatgaaaaatttggaggtaagatatctggagcggctggcggaattgtatcctacaattgcggcggcttcgacggaggtcatcaacctggaggcgattgtcaacctgccgaaaggaacggagcattttttgaccgatatccatggagagtatgaggcgttttcccatgtgctgaagaatggctcgggggctgtgaagagaaaaattgacgatgtcttcggcaataccttaagccgtcaggataaacagtccctggcaacgctgatctattatccccgggaaaaaatgagccggattttacagacggagacgaacccggatgactggtacaaaataacgctgtaccgcctgattgaagtcagcagaagagcagcgagcaagtatacgcgctccaaggtgcgcaaggccctgccgaaagaatttgcctatgtcatggaagagcttctcaccgaaaaagccgatttaacggacaaagaatcatattatgacgccattgtccagacaattatcagggtaggccgggcaaaacagtttatcattgccctgagcgaattgattcagcgcctgatcgtggatcatctgcatattgtgggggatatctatgaccgtggcccgggtcctcacattataatggataagctgatgacttaccattccgtcgatatccagtggggcaatcacgatgtgctttggatgggggcggcggccggtcaggccgggtgtatcgccaatgtaataagaatctgtgccagatatggaaacctggatctccttgaggacggatacggtatcaatatgctgccgcttgccacatttgcattaaatacgtatgcagatgacccatgcacctgtttccagctaaaaggcggcaacacctatgacgcatcggagatggaaatcaatttaaagatgcataaagccatatcgatcatccagtttaaggcagagggccagattatcaaacgtcatccggagttctgcctggaccggcggaatctgctccatcgcattgactatgaaaaagggacaatagaattggagggaatcgagtatccccttctggatacgaactttccgacgattgatccgaaggatccatatacctttaccgaccaggaagcagatatcatggaacggcttgagagggctttcacgaactgtgataaattgcagcagcatatgaaattccttttggcaaaaggcagtctgtataaggtatataataataatctgctctaccatggctgcgtgcctctgaacgaagacggcacgttcaaagaggtcgaaatttacggaaagaagtataagggaaaagccctttatgatattctggataattacgtcagaaaaggttttgtggcaatggaccgggaagagagggaacggggccgtgatttgatgtggtatatctggctccatgagaattccccgctttttggcaaggataagatggctacgttcgaacggtattttctgacggagaaggagacgcataaggagacgaaaaatccctattatcattttctggagaatgaagaggtgatggatcggattctggcggagttcggccttgcaaaagagggggctcatatcatcaacggccatgtgccggtcaaatccaaggatggggaaagcccgattaagtgcggcggaaaacttctggtgattgacggagggttctcaaaggcttatcagaaagagacgggtatagccggttacacactgatttacaattcatacggcctgattcttgccgcccatgatccctttgagtcaacggaggcggccattgaaaatgagagcgacatccattccgacagcaagatggtgaaatgggtgccggaacgaaaatgtgtgggtgatacggacatcggccgtgagctgaaagagaagataaaggatctggaaaaacttttggaagcatattatacgggtacaatcgcagaaaaatttactgttcagtaagcagaaatatggtcaaaaacaagctcattttcccggtggaatctcaccggaaaatgagctgtttttttcttttgaaggaacagaagaagaacaaaaatgtcgtaagtgttaagaaaactttacatttgttacaaaattaacataaagaattaataatagaagtatattgtatgcagtatcctaaataaatggaagaatagtggaaagtatccaaaaaaatacaattttttctttgctttattgtctgaatgtactataatatgagtgaataaaaaaacagtgtatcacactgaaaacaggagggaatgtagtatgttaagtttttttatttgccttgcgctgctgattggcggctattttgtctatggtaaaatggtagacaatacgtttgggacggatgacagggaaacacctgcagtgaggattaatgacggggtcgattacgtcgtcatgcctcagtggaagctgttcctggtgcagctcttaaatatcgcgggattaggcccgatattcggagcgcttcagggagcattatggggcccggttgtctttctgtggattacatttggtacaatctttgccggcggtgtccatgattatttttcaggaatgctgtcggaacgtaatgacggcgcatcgatttccgaggtctgcggtatctatctcggaggactgatgaagaatgtgatgagggtattcagtattgttcttctggttatggtcggcaccgtatttgcagtcggtccggcgggtctgattgtcaccctgttccagaacaacggcgccgcaggccttgtgacaaacaaggagttttggctgtgggtcattctggcctattattttattgcaacctttatttcaattgataagattatcggtaaaatttatccggtattcggcatctgccttattattatggcagttggcgttgccatcggcattttcacaaaagcggagtttgtcattccggagatctggtcgaatttccataatatgcatccgaagggaactccgatttggagcgttatgtttattacggttgcctgcggagctatttccggcttccatgcgacacagtctcctctgatggcgcgctgtatgaaatcagagaagcaggggcatttcgtattttacggagccatggtgtgtgaaggcgtgattgcccttatctgggcggctgccggatgctccctgtatgccgttacaggcggccttaacacaggacttcaggaggctcttgccaacggtcagtccgctgccatttatgatgtgtgcaagaagacgatgggcggaatcggtatcgcacttgccatgcttggagttattgcatgcccgatcacttccggtgacacggctttcagaagcgcccgtcttgttgtggccgactggttcaagattgatcagaaggcatatgccagcaggctgaagctttgtattccgcttctggctgccggtgcgattatcggacatctggattacacgattgtctggagatatttcagctggacgaaccagacactggctatgatcgttttgtggaccgccagcatgtacctttacaaagagaaaaagaactactggcttaccgctgtgcctgcaacctttatgagcgccgtatccatgacgtatttcttctatgcaggcgaatgcctgaatctgggcacgacggtggcgtatccggcaggaattattctggcggtagtattccttggaatctttatgcgtgcaactaaaaaacagcagaccgcataagtacggccgaaacttacggaaaccatatttacgggtgaaccacaaaaacagaaccggagataaattatgatttttaagccagtaaaactcggccgtgacggcctgacggagcaggagcttcagacagacaggaagaagagccggaatttcggaccctgcggcgtgggagaaaaggcgctgtacctgaacagcttttacatagacaggcgatattatattccttttacgtccgttacccgcgtttttaagcgggtggcgatgagcaggggaggtttcagcggcaaagggatgtttgccacgattccttatcttgtagtggagtatgatgatgggaaggaaaagcagtgcaattttaaatacgaagagaatgtagaccgcatgctggcctgcatcggcaagtcccaaccggagatccggctggtaagccgggcggcggaagagaggcttaaaaagagggagcaggagcgcgcggagagatttcttcctgaactgtcaaaagaagcacagggagaggccggcaggcttcaggaggcaagagagtatctggaaatcaggccggagcttggcatagcgttaagtcagtcggccagaaggaaaagagcctacgacaagagcagcccgagttacaaatgggttgctctggcaatctctcttctgggcgccgcttctcttatttacgggatatattccttgattaaccacgtggagtttgccgtttatttcactcttttcggaatggctgcgatctttttgttctccggcgccagtatgctgccgacctccaggaataacaggacttatatactgaacagggtcaggctggcgaaggaggagatggaggaatatctgaaggggtacggagggaaaagcggtttccccgtaccggccagatatgcccatcccgttgtgctgaaacggatgattgaaattattatggagggaagggctgaatgtgcagataacgctttggaggttttaaaagaagatttaagggccttgaattccgatgtacaggtggagcaggaggagtatgaggaagtggtggcaataaaggccatgtttttaaacgaagattacagatagaaccgcttttgaaaggtattcataagcggaataaggctgagccggagagaatggttatcttttgctcagccttttactgatggcggggacctgtgcgcggagcgttcaggttaccgttcaatacgttcttcttattttgttccgaaaatccgatctccggcatcgccgagtcccggacagatataggcattctcgttcaggcagcgatccacatgtcccacgtaaatctgaacatccggatgagcttcatgaaggcgtttgagcccttccggggcagctataatcgccataaatttaatcgtcctaccgccgtgctgtttgataaaatccacagcctcaacagcagagccgccggttgcaagcatcggatcagtcaccacaatcgtacgcagttcaatcgggcttggaagcttgcaatagtattcgtgaggctgatgggttacctcgtcgcggtagagaccgatatggcctactttggcagaaggaaccagtgccagaatgccgtttaccattccaaggcctgcgcgcaggataggaacaacagcaagtttttttcctgacagcatgggtgtcatacaagtttcaatcggagtttcaacttcagcgtcctcaagaggaagatcccggagcgcttcatatcccattaacattgcaatttcgtcggtcagggaacggaactcattggtaccggtcgccttattgcggagaatggagatcttgtgctgaatcagagggtggtctaaaattgttacgttttccatagtaaaaacctgccttttaaatttatagtgttttcagagtaatataaaaaaatacatctgatttaagtattgccgtttaagattttgtgccttaacacaaaaacatgtaacggttcagaaagcatgaactgttacaaaaacattcagacagatgtattatacacctgtctgaataatcttgtcactatataaatagaatatttaagagaattgttgtaattttttggaaagaattgtcaacttatatccgggcaggcctgccgtcttgccggtaccggcccttccgaatctgtcagtctgctatttttctatttattatcaggactgtatttaataatcgcataattgccgagttcagaggaaagagggatacttacatagacaatcccctgtttttcatagctgaatatctcgggccagctggcagccggagtgctgttctcatcagctgtataaccgcctgaaaaatcagccgcctggagtttcttaaaataataatcggtggtcttttcggaactgttgatatagctccttacggactgttcattggcggaaacggattccagcttgtaatcgccggatgcaatataaccggctacggtgtaagcgtcggcataatcgctaagccgcatgttctgaactgtctcaagatcaaccgtattggtatagaacaggttctccgtctttgaagtggacggattcttcaactcgcctttataggagacgacaatccgtttcaggttggcggcttctatagtagctttcaccgataaagtctgatccggatggacatcggcgatagccattgcattcgtacggagcagggcattcacctgcttctgtttttcggcatccttcatgttggagacaaccgggtattcgaccgtcgccttgcctgcggtttcttttttaatctctgacttcaaagaaaaattggcgttattctttgacgcatcggcagactcctcagtcggtgccgtggtaggcgcctccgtagtttccggtatggtctctttctcaacagcggcagtagtatgcagtgatgataaatcgacagcctctcttttcttgcagcccgtaaaggccaaagcgcagacggcaatcgttgcagcgatatacagtttttctttacgcatagtttccctcctcgtgaaatttattgattacagcgaaaagccagcttatgattcaatatctggttcacggcaataattttgccttatggaattattatacaataattttgccgaaaaatgtcagaaaatatcattgaaattttcttaattttttagtcgaaatactttctttccataattaatgccgtgctaatgattaattgaaatacggcctgccgctgatggctataaggtgatttccataccatcataggcaaatgatatgttatctaagtttttttcaaattcccggtaataagcataggatttgccccagtattcgtcaatgtgggtgatgataatgcgcttgattctgtaagtatgtttgatttccaaaagttcctctaaggtgaacatatcatctttaaaaggcgcatcatcaagtgcccggccttctttgagcatgccgtcatcagaaaccagtccgattattaaaatatccgcatcataatacaattcattgaacacaaacggcttcacatcacagcaggcataaatcacctttttgtccccgtctgagataacataaaatgtcatattgccgcgatgggttttgttatttaccaggtgtatttctatttttcctattttgatgaaatctgtcttaataatggaaatacaatgaagaacattttcatagtagtataggccgtctccgttccacgcattgatatcgtccacaactccgggaagcgcaatgaattgtacgggagttcccctgtcggttatacaattgtagcccaatggctccacgatacgcatgcctctcgtatgatccgggtctttatgcgagatggacagatattcaattttagaaataccctgacggtcacaggcgacggcaatgtcttccggagtatcaataagcatatggatgtcctcaatataaaggctcggccctaaccgttcataccggccgcgtttgattctcgcctcctcacagatgggacatttgcaaaatggatttggaatttgaaacattccgccgcttcctgcaatctttaatttcatcaattttacctcccagcctcttttattttattaacatctccctaatctgtctaatcatgcctgctggaattgtgtcgtcatccagcggcatgatactgctcagcatccggactccctgataagaaaaaaggagcagatcaacaacggcgttaatattcacctgccaaaactcgcctttgctgattccatacttaatcagactgcaaagcattgcttttgaaatgtaatactgtttcagcatggcgttatcgtcagatagtggaatactgctgtaatactcgtaaaaagcaagtcccagtgaaccgcttctgtcaagcatttcggactggtaacgttccagtaactcatccagaataacggttgcagactgaccgttttccatcttttcggcaatgtcattttccaggccggacataatttcatttatgatgtcggcaaaaatctgtccggtacttccataatgcatatataaaccgccgcggctcagtcctgctgcttcacatatgtctttcatcgtaacatccttaaatcccttccggataaataaatgtagcgccgtgttccgtattgcggcctttgttgcatctccctttttacccatggctttatccctccccgacatttccgacatgtgtgtctgtttttaatatacgacatacgtgtcggaaagtcaatgaattaattataagtaaaccttcttattaaaaatcattaaaactaactggtaaagaatatagaaaatggtatataataaaatcaggttactatttttcaaaatgtaattataaaagcagaaacaagatataaaaagcgtaagcaggaggtccatactatgaaaatgttatctattgcagaggaattgaagaacaattcctatcccggccgcgggattatcatcggcagatcggcagacggaacaaaagccgtgacggcatattttatcatgggtagaagtgagaacagcagaaaccgtgtatttgtggaagatggaaacggaatccgcacacaggcattcgatccgtcaaagctcacggatccgagcctgatcatttatgcaccggtcagggttctgggcaataaaacgattgtgacgaatggagatcagacagatacaatctatgagggaatggacaaacagcttacatttgaacagacgctgcgctgccgtgaatttgagccggatgcaccaaattataccccgcgtatttcaggcatcatgcatattgaggacggcggctacaactatgcaatgtcgattttaaaaagcaacggaggcagtccggattcctgtctgcgcttcacatttgcttatgaaagtccggcgccgggggaaggccattttatccatacctacatgcatgatgcaaatccccttccaagctttgagggggaaccgaagctgatctcgattccggatgacatggaagcgtttgcagagcttctctgggaaaacctgaatccggaaaacaaggtttctttgtttgtgcgatacatcgacattgcaaccagagagacacgctcaaagattatgaataagaatcagtcataagacccgacgggtatagcacaaaggaggaatttccataatgaaagaactggaattaaaatacggctgtaatccaaaccagaaaccatccagaatctatattgaagacggaagcgatctgccgattcaggtattaagcggccgtcccggatacatcaattttcttgacgccttcaacggctggcagctcgtaaaagaactgaaggcggccaccggacttccggccgccacatcctttaagcatgtatcaccggcaggggcggcggttgggcttcctctcgatgacacaatgaagaaaatttactgggtggaggatatgggagagctctccccaatcgcgtgtgcatatgcgagagccaggggagctgaccgtatgtcatcgtttggtgattttgtatcgctttccgacgtctgcgacgcggatacggcgcgcctgattaagcgcgaggtatcagacggtgttattgcgccaggatatacgcaggaggctcttgaaatcctgaaagcgaagaagaacggaaactataatgtgattcagatcgaccctgactatgttccggctccggttgaaaagaaacaggtgtacggaatcacttttgagcagggaagaaatgagcttaagattgacagggagcttctctcaaatattgtgacggagaagaaggagcttcccgattcagccaaaattgatatgatggttgcgctcattacgttaaaatacacgcagtccaattccgtatgctatgtaaaggacggtcaggccatcggcgtcggcgcgggccagcagtccagagtacactgtaccagacttgcaggccagaaagccgataactggtacctgcgtcaggctccccaggttctgaacctggaatttgtggatggtataagaagagcagacagggacaatgcgattgatgtgtatatcggtgaagaatatatggacgtactcagcgaaggcgcatggcagaagatattcaaggtaaaaccgcccgtattcaccagagaagagaaacgcgcctggttagaccagatgagcggtgtcacccttggctctgatgccttcttcccgtttggagacaacattgaacgcgctcataagagcggagtggaatatatagcccagcccggcggctccgtgcgcgacgacaatgtgattgaggtatgcaataaatatgggattgtgatggcgtttacaggtatccggctgttccatcattaataaatgttccgttgccacccggccggaattatcgcaaaaatcttgcgtaaattccggccgggtgacatcaggtccgaattgtgataacaaattatctgttttttataaaagtggttgcatttttcttataattttggtaatataatattcgctgacagcacgccggcctgtcggaatggcagacgaggtggactcaaaatccattggtggcaacaccgtgcgggttcaagtcccgcggccggcacgaagcataaaccgtgaattttctggtaatatcaggagatttgcggtttttttgattactgtaaaaagtagtccaaccagaacaggaatgtggtataattgaggtgttacattcggtgatgaatataacagaaatacaaatcaggaggggaaaagcatgaaaaagaaaacaatccgattaacaggttttgcattggcgatgatgctcagtttatcgccaattgtgccggcgggcagtaatccatttgtgttcactgctgaggctcattccggcagaacagattcaagcgggggccaccgggataataagaataagagcggattgggcagttatcattatcattgcggaggttatccggcccatttacatacgaatggagtctgtccgtataagaatggggctgccggcagttccggaagcacaggctctgccaacggtaatccatccggcgccggaggtactcaggctgccgctccgataccggaaacaacggctgcagcgcccgtggaaactttaggctggaaacaggatgaaaagggctggtggtacaaggacagtgaaacgacttataaaaaagacggtgtatatagtattgacgggaattattacgcttttaacgccgaaggttacatgataacaggctggcaggagataggcgaatactggtattattttgatggaaacgggcatatgctgatagatgtttgcactgtgattgacgggtcctattgttatttcgataaaaatggcaggtgggatgaggagtattatgacagcttcagtgattacctggataattatgattattaatacagcattgcaggtatgggaatataagagggggaaggtttcggcgctcccggcgcaatgacaggaaaaaggatacaggggctctaatttaaaggctcccgtatctttttttattgaacaggtcaccgccataaatataaccgttttgcgggtatcactgcgggcggatgctaaaactgacctttaaaaaactattaaaattggatgtttttatagtgtcagtccaatgctataatggggacacatgagaatctataatagcagaaggtgaggagataggctatgaacaatgagagaacaatgaatacacacagagagggcagtgcggctggcagaagagaggttcattcgaacgtgatgtcggtcgtcatgacagcattttttgcggctgtaatattcctgggaatccagtccttccggataccgctcccggctgcagtaggaacgccgtttcttcatttcggccatatttttgtaatgctttcgattgtttgtctgggtggaaaacgttctgcggtgtcaggagtattaggcctgataatttttgatattttaaatggctatcttcacgccattcccaatgtgtttgtcagtacaattataaaatgtctgtttgtgggggccgtattctcagttatgaaaagaagagcggccggggaacggaagaaagagtacatggcggctgttatctgcgcagctttgtatggaatcacaaatatcgcagtagattttgtctggtcggttgcggaacttgttttacttggcagtacgctcagcgcagccgttgcggcagaggtgatgtccattccggctacgattatcaatgcaggctttaccgttattgggattgctcttctttatatccctgtaagctcggcctaccgccgtatcggttagagatggcatatgctcatttaatgtggtaagcaggacgggaaaggacagggacaattgctatggatatgaccgcaattcagacacttttaaaagaatatgatctggacggatggctttttacggattttcagggacgtgatcccattacacatgattttttgaaactgactgaccggaagtgtaccagacgtttgttctattacattccggcagcaggtcaaccggttaaggttttgtcggcgattgaaccgcttcttttggaacatttgccggggaagaagttcctgtataaaggaatacagggacaacgtgaggtgctggcgcagatattggagccgggtaaacgcattgcctgccagtattcgcccggaggcaatgtcccgaccatcagtaccatggacgccggtctggtggaatatttgaggacattcgggatggagccggtgtcctcagccgatctgatgcagcatttcggcgcggtgcttaccgaagcccagattgagtcccaccgcaaagcaggggttatcatccatcggattttggatgagatattctcctggattcggaaaaatctgaatgagggcaggtatattgacgaatggatgatgttgaaagagtttgggaggctgatcagagcagaagaaatttatatggattcgccgccttttttcggcatcgacgatcatgcctgcgacccgggatatgagccggagccttccggttcgcggcagatccgggaaggcagccggctgattattgacattgccggccggctgcccgaagaagatgccgtctactatgatatctcctggtgcatgaatgtggggccggagattgacccggaatacgaacggttattcaattcggtatataatgtcaggagcagggttttgtccttcatccaggaacgtctgaatgagggaaaggcaatctgcggatacgaagccgatgcgctggcgaaaacgctgttccgggcccagggactggattcgtatatcatgcaccggaccggccataatatcggacataactgccatggaatcggagccaatctggatgattatgaaacgcatgacgtgcgccgcctcctgcctggtaccatgttttccattgaaccggggatttatacacaggagtacggtgtaaggctggaatatgatgtatatataacaaaagataaaaaaacgaaaatctttgggccggtaccggataagattctggtaatttgaaataattgttttcagtgattgacaaatggtgtgagataccctataatgcaactaactattttacgggagtgttcattatgacagcaaaaaattatgcatgtgcgaatacaacagcatatacattttatggctactggtgcttttattttgtaccggttctttttgctgcgcgtgagcatttacggatagtcagacagtatcagtagccagatacttagcgggagatttgacgagccgatgtttgcatgtgcagacacggctcttttttaatttaacaggaaacattcctgttaaattaaaaaacgctctgcggaggatcctgcgagcggatttccggataacagcaaaagccccgcagagacgggcagaagggagacacatcatggagcagaaaattttagattgtacattgagagacggaggactggtaaaccgtttttattttacggatgactttgtgcgcggactgtatcaggcaaatttacaggcaggcattgactatatggaatttggatataaggcatcggaagcgctgtttgaccgcagggagttcggaaaatggaaattctgccgcgaggaagatttgagggctgttgtcggggataataaaacctccatgaagatttccgttatggctgatgtggggagaaccgactacagtaaagacattttggaaaagaaggacagtgtgattgatatggtccggattgccgcctatgcggaacagatgggggaggcaatggagatggtaagctgctgcaaagagcgcggctatgaaacatcggtaaatattatggcgatttccaataatacggatgaggagatagacagggcgctggaaaccgtgagtaaaagccgggccgacgcagtctatgttgtggacagctacggctccttttatccggaacagattaaagcgctgacaaaacgatacattagattggcggggaatggcagaaaggtggggatccatgcccacaacaaccagcagctggcatttgccaatacgattgaggcaatgcggtgcggcgccgcgcttctcgatgtgacggtgaacggaatgggcaggggagccggcaactgcggttcggaacagctcttgggatatatcggctcatcggaaaaatataatgagctgccagtgatagagtttattgaaaatcatgtccttccgttgaagcaggccggcatcctctggggatatgacattccgtatctcctgacagggcaggggtgcaagcatccttccaaagcgatagaatttgtcgagaaccacaggacggagtacgcgggattgttcaggcagatgatgggggcgtaaaacaatgaaagggatcgcttgaaaaatcgggtataatattgtatgatatacgaaaatgggcagagcaggccttgtggaggttgtgctctgccgttacaatggaggtgatggcagtgacttgtcaggaagcagagcatctggtgacgccgtatattaatgatgaactgaccggtgatgagacggaagcatttttggcgcatattgagtcctgcaggaactgccaggaagagctggaaatctattttatggtagatgtcggactgaagcagctggacaaaggctacggtacctttgatatcgcaggggcgctggaacgcagaatcgaggaatcctattccagggtacacaggatgtggctgttccggtcacttaagtatgcagtcaacacgctcagcattatggcagtgattgtgacggtgcttctccagtttcgaatctggtttttttaaaattgacaggggtagtgtcaagtgatttatgaaaaccgatggccggggaacccggcgtaaatgaaccttgtaaattacagatatatttagaaactggcagtgtccgccacccttgacggcacaccaaaacaatgctctgaacgtcttaccgacggcgaagaactcaggaacagataagatttcaccgtctgcgtcacagcatgatagcattgttttggcgtgccatcaagggcaggtcccttcgggatggctgcatttttacctctggcccggaatctaagaacagatttaaccggcagcctgctgttccttcagctggaggatggtctgctgaccgagcagaatcaggagctgccacttcccgggcatgttgtcagccccctccagcataccgactggattgagcacccgatagtggttgtgcttatggggacggagaaagttgtagtaggcgacccagagcgccacgttatagttggcgccattgtaattgtcgtaaccgcagctgacccggtaagtggatttaaacgtgcggttaagccgttcgatcatctgcttgtaggggcggaactccttagagaccgcatcattgtttgtgagtccgattacctgggtaatgtcaaactggaagctgtctcccaactcccttacgaactgctgggcggccagaggataagcactatagccgtcggcaatgaaccgaaacttctcggggagtctttttatgccccggaaagccatgcgcatggcgaggatgcatggcccgacagagcggttgtctgaaacctggtagccgaggatggagcgggaagcggcatccatgatgaaccagatgtagcctttgatgccccggactttgatataagtctcatctgccgtaaagacggaggactttggatattcatagtggtcaacaaagggtttaatgacaatggcggccgttctggcatagttggcgacctgctgatgtgagatcctgattccgtaaaggtcatacagagcctgagccgttttacggagggaaagctggaggttcacatgcatggtgaggcacagggacatgatatgagcgttatgtttggaaaacttcagggaggaggaattctcaggcagggagtctaagtccatgcggaagaaatccaccgtgaattcccggtagaggtagtgcagcttatacttgtttttaccgtaatcctcatgcagatggtccttatcaaccctggagaggttgtgaaggtagaaggagcacctggggttgacgcatttatggatgcggaaaaacttccggtccttattagggacgagggagtggccgcagtaagggcatacaaagcggagaggcgatgtgacaacctcgccggtgacaaaggtctgcccacagactttgcattggaactgcccattgccgccattattatcgtagagatagtggtgaggtgccccacaaagaggacagaaggtatcttcagggatggatttaccattgcggcgctgaacgggtctgacggatttgccgtacttccagagatagtattcaaggagaaactgccagtcctgtttgatgaacggcttgaggagcgggagggggtcggtagtaaacttctggtatttaggggagtgggaaccatcaaaggcccactgcttgagtggaatatatttgcagataaagttcaggagccagcagatagttttgtattgttcttgaattatagtgagtaaatagagtataatgttatccataagcaatgatttatcctttttaggtgatggtttgtggtgaactcattataccagaaaaggggaggtcattgcttttttattttcaaaagtggtgtaatccctgaaaatacaaggtttttaataaaaaacggagtgtcagacttgacactaccttgacaggacaggagacaataacatgagtaaattagtactgatagacggccacagcatactgaacagggcattttacggtgtgccggaactgaccaattccaagggccttcatacaaatgccgtatatgggttcctgagcattatgttccgggttatcgaggatgaaaaagcggatcacctggcagttgcgtttgacttaaaagatcccacattccgccacaagatgtttgaggcctataagggaacgagaaagccaatgccggaagaactccatgaacaggtccctgtcattaaggaagtgctggcctccatgggcattccaatcctgacacgtcccggctatgaagcggacgatatcctgggaacgattgctaagcggtgcgccgcccagggagtggaggtttctgttgtctcgggagacagggatcttctgcaattggcggatgagaaaattaagatccgcatgccgaggacatccaggggaacgacggagatcaaggattattatcctgccgacgtacaggcggaatatcatgtgactccaacggagtttatagatgtaaaagcgctgatgggagatgcatcggacaatattccgggagttccctccatcggtgagaagacggccaccagcctgatcacggcttatggttcgattgagaatgcctatgcgaatatcgatgaggtaaagccgcccagggcgcagaaggcgctgagggagcattacgatatggctcagatgagcaaggaactcgcgacgatctgcattgactgcgatatcgattttacgctggaagacgcaagaatcaacaatttatatacaccggaagcttatcagcatatgaaacagctggagtttaagtccattctccagaaatttgatgctgatgttttttctgcttcgaaagtggaagagcattttaaaactgtatcggagctttccgaggcggagaaaattttcagtgaggcagccggaaaacaggaagccggaatgcagcttgttattgagaacggacaggtggccgctatggcgctctgttacggcgaggaaaagatttacagcattcccgcagcaggctttatcacaggtgaatatctggcagagcggatggaagagctttgcacggccgttccctctgtcagcgtgctggatctgaagccgcagcttccgtatctcaagaacagggacaggcgagtggtggacggcagcggcaacgatggcggcagtgaggccatgttcgacgccggtgtggccggatatctgctgaatcctctgaaggacacttacgattacgacgaccttgccagggattacctcgatatgacggttccgtctaaggccgatttaatgggaaaaacttcatttacggcagcatttgacatgatggccgacaaggcgcagacctgcgtctgctatatggcatacgtggcgtggaaggccaagcccgagctggttaaaaaactggaggcatcggggatgcgcaaactgttctttgatattgagatgccggttatttacagtctctatcatatgcaggaagaggggatctgcgtacgcagggaagaactcaggtgttacggggagaggctgaaggtccagattgataagctggaacaggagatttatcaggatacggaaactgagtttaatatcaattcccccaaacagcttggagagatcctgttcgaccggatgaagatgccgggcggaaaaaagacgaaaaccggatattccaccgcagccgatgtgctggagaagctggcgccggaatatcccgttgtcagaaaagtgcttgactacaggcagcttacaaagttaaaatccacttatgcagacggtctggccgcttttatcagggaggacggccggatacacggaacctttaaccagacgataacggctaccgggaggatcagcagcactgagccaaatctccagaatattccggtccgcatggagctgggcagggaaatcaggaaggtatttgtcccgcaggagggatgcgttctcctcgacgccgattactcccagattgagctgagagtcctggctcacatgtcgggggatgaacggctgattgacgcctacaggatggcggaagatatccatgccattacggcatcggaggtgttccatgtgccgcttgaggaagtgacgccgctgcagagacgtaatgccaaggccgttaactttggaattgtatacggaatcagcgcgttcggactcagtgaggatctgagcatttccagaaaagaagccctggaatatatcaaccggtactttgagacatacccggaggtgaagaaattcctggatcaccttgtggagctgggaaaagagcagggctatgtggaaacgatgtttggaaggagaaggccgattccggaactcaaatcggcaaacttcatgcagagatccttcggagagcgcgttgcgatgaactccccgatccagggtacggcggccgatatcatcaagattgcgatgatccgggtggatcagaggctgagaaaagagaagcttcgctcccgtctggtgctccaggtgcacgatgagctgctgattgagacatggacggatgaacttgagaaggttcagaaggttctggaggaagagatgaagaatgcggcccatcttaaggtggagcttgagatagatatgaagacagggcattcctggttcgagacgaaataaaaagcaggacgaaaaagaacagggaagttcaaattgagatataacagaagcggcaggatgtggaggaagagaatgaaagtcatcagcatcaccggaggcgtcggctccggcaagagcgaagtgcttcggatattgcaggaagagttcggggcggatattatcatagcggacaaggtggcccaccagctgatggagccggggaagaaaggctacggccgggtggttgccgcctttggaacctcccttctgagcgctgacggaagtatcgaccggcagaggatggcggagctgatattcagcgataaggattcaatagagaagatgaattccatcattcaccccatggtatggagtgaaatcgaatatgcgatagcccattccgacaaaaatctggtggcagtggaggcggctctttttgacgaggaacacaacgctatgtttgatgaaatctggtatatctttacaagcagggaaaaccggattaaaaggctgatggaaagccgcggctactccagggagaaatgcctggaaattatggcaaaccaggtgtcggaggatgaatacagggcgcaggcggaccgtgtgatagataacaacgaaacagtggaagagatacgtactcagataaagagttacattcacggccccgctgaaaagcgcggttccgcaatagtaacgataaagaacatattggaagaggaataaagcagatgcggatggtaagtatagcaagcggcagcagtggaaactgcatctatgtgggcagcgatgagacccatattctgatagatgccggaatcagtaataaacggattgaaaagggactgaatgaaattggggtgacgggaaatgatctggacggaatcctgattacacatgagcattccgatcatataaaagggctgggagttctggccagaaaatacggcactccgatttacagcaccaaggaaacgctggaggaaatcggtaatgtgaaaagcctgggagattaccccagggagttatttcgtcccatctgtcatgatgtggacttttacataggcgaccttgagataaagccgttccgcatagatcacgatgcggccaatccggtggcataccgggtccagaataaccggaggtcggtggcggtagctaccgatatggggcattattcacagtatatcattgaccatctgcagggactggacgccattttgctggaatccaaccacgatgtaaagatgctggaggcagggccgtatccatattatctgaaacggcgtattctcggagattacggccatctttccaatgagaatgcagggcgtcttttgaactgtatcctccatgacaacttaaaacatattttcctggggcatctgagcaaggagaataattatgaagaactggcttatgagacggtgcgtctggagataagtcagggagattcgccgtatacggcgtccgattttcctattacagtagcaaagcgtgacgaaatgtctccgattgttacattatagatttgtactactaaaaagagaagaccagagaatcgaggaggaaccgctatgagcaaaattattattactatcgttgggaaagacagggtgggcattgttgccaggacgtgcaattacctggctgaaaacgggatgaacattctggatatcacgcagacgattctgcaggagtattttaacatgatgatgatcgtggatatttccggatccccgaagtcctttgacgatatggcaaaggagcttgaaaaggtaggcgaggatatcggcgtcacaatccgctgccagagggaagaaatctttaccagcatgcaccgcatctgataacggggcaggagaaaggacggaataaacacatgattaatatgtttgaagtaattgagaccaacaatatgattgcccatgagaagctggacgtacgtaccatcacgatgggcatcagcctcctggactgtattgacagcgacctggcgaagctgaatgagaagatttacaataagatcacttcctatgcaaaggatctggtatccaccggagacgctattggaagggaattcggagttccgattgtgaataagagaatttccattacccccattgcgttagtcggcggcagcgcctgtaaatccacggaggattttgtagagatagccaagaccctcgataaggcggcgaaggaagtcggcgtcaattttatcggcggatattcggctcttgtgtctaaagggatgacacctgccgaggaacgcctgatccggtcgattccgcaggcccttgccgtgacggaccgcgtgtgcagctccatcaatgtcggttccacaaaaacaggtctcaatatggacgcggtacgcctgatgggcgagattatcgtggcgacggcggaggcgaccaaagataaggattctctgggatgtgcaaagcttgtggtattctgcaatgcgccagatgataatccgtttatggcgggagccttccacggcgtgactgaagcagatgcgataatcaatgtcggcgtcagcggtccgggcgtggtaaagacggcgcttgagaaggtcagaggggagaattttgaagtcctctgtgagacaattaaaaaaactgcgtttaaaatcacccgtgtcggccagcttgtagcacaggaagcttccaaacgtctcggtgttccatttgggattatcgatctttcccttgcgccgactcctgcgatcggggatagcgtagccgagatcctggaagaaatcggacttgagcggagcggagcgcctggaacgacggctgcccttgccatgctcaacgaccaggtgaagaagggcggtatcatggcttcttcttatgtgggaggcttaagcggcgcatttattccggtcagcgaggatcagggtatgatcgatgccgtggcggaaggggcgctcacccttgaaaaactggaggcgatgacatgtgtatgttccgttggcctcgacatgatcgcaattcccggtgatacaaagccatccacgatttcaggcattatcgcagatgaggcggccatcggtatgatcaaccagaaaaccacggccgtccgtctgattccggtaatcggaaagaaagtcggcgatacggctcagttcggcggccttctgggctatgcgccgattatcccggtcaataaattttcctgtgacgccttcataggcaggacgggacgcatcccggcgccggttcacagctttaagaattaaagttagttggggcccggaggacgagtacggaacggaccacggatgttcccgtctgcgtcctccgggcctcaattagtaacagaaagatggaatagcaatggctgataaaagagaattggaagaagcgttccgcttctttttaaacggggagctggaacggatgattttcagcaacccccgcaaccgtgatcattacatcaagatgactgtgcgtccccttatgcttaaggggacgctgaaatttcaggtggaagagtttacggaaaaacaagcgtttcaaaaaaatatggacagggaagaagcactttcttatctgcttaagcagcttgacagtctctaccggaatggggaggtcgtctcaggggccggttccatgaatgtcctcgttggtaaaaaggggacggtcactgtgaagaaaaaactgaagatagcgcccggacagaagggaaagggctctgcctcaggaaatgatctgtctgcggaggctatggagcgcctggcgagccataaccggaagaaaaattacgttttggcggaaggcactccggttccctttctggcggagcttggcgtgatgacggcggacggaaaggtagtgaaggcgcggtatgataaattccgccagatcaaccggttcctggagtttatcgaggatattctgccgaggcttgaccggaaccgggtaaataccatcatcgattttggctgcggcaagtcatacctgacgtttgccatgtactattatctgaaggagcttaagggctatccgattcaggtggtgggactggatcttaaaaaggatgtaattgcgctctgcaaccggctaagtgagaaattcggctttgagaatcttcatttttaccatggcgatattgccggttatgaaggcgtcactcatgtggatatggtggtgacgctccacgcctgcgacacggccacggattacgcgatggcgaaagcggtcagatggggagcggatgtaattctgtccgtgccgtgctgccagcatgagctgaacagccagataagtaacgggctgctccagccggttctgggctatggactgctgaaggagaggatgtccgcgcttatcaccgacggtatccgcgcgcagcttctggatcagtgtggatataagacgcagatactcgaatttatcgatatggagcatacgccgaagaatattatgatacgggcggtgaagcagggaaaaccaaagaaggatgaagggctggaacttcagaaattaatggaggagctgcacgtggagccgactctttaccggctgcttcgggaagaattgtaaatacaaaggaagagtaagtgaaaagggaatgcgtctcatgaggcgtgttccctttccggctttacggagacggtatcaggcagcaggccctgggtttctattcacacggcaatgtcagttagttaacagtgtaataaattggagatttaactgaggttgggaggacgcgtccggaacggaccatgtccggtgtggtgagggggatggctgagtcttccgtccccgtgggaagttggttgtggagggggaatccggccggaatgaattgctgcggggaccgtttgcactctttggagtgcgaggcagtgctaagctcgtgagggacctcgccaagcaccggcggactcccatgtccccctccgcaattgattccgcctacttccccggggcagatttttgccagggacggaagactcaggcggaagttttcgcggcaccggacatggtccgttccggacgctgattgtctctaaccttaaatggggaggaccctgtcgagaccactacgtgtttccggccggccgatatcaaatcttccacaattccttaataaaggtgcattgaaagcatatcgtatttcccgttcacggaagcgcttagtggccgcgacaaggtccgccccgcacttaacgcgtgagacattcagcggccgcaggccagcggacggggccgatacacccggcggagtctttcgtcctggcgaaaacccggccttggggcggaggggaagataaagtctgcggatgccgttgaaatccatcgctgattagcgaggtcccttacgagcttagcagcgcgatgcatttcacagagcgggagtgtgctccgcagactttatcttcgcccgcagccccaaaccacgacaatctcccccgggacgaaagactcatatacacaccccaccaccccgtccgctggccgttccggcggcgtcctcacctgcttaactaaatctccatagtgttaactaactgacattggttcacacagttgtaactccggcccagtaccggaaattataacgccctgcgtatattcgttccggaaggttccgccttttgtatgccggatcatctgataaatatgggcggaacggatttcctgttccagcatggacagcgcgtttttgtccagtttcttacctgcatcggccagctttgtaatgagcggaatgcaggaggagtgtttgagcctgctcaacagcggcccggagtccttcctgaaaccgagaatcctcgcatagggagcgtagccgctggccttaaagcggcagatatcggactcctgtatatccagaatcagatgtaaaagcgcccggctgacccgggtgtaggtgagctgccttgtctttagggcccggatccattcttcaaaggagacgggcaaggctgcgctctttctgatacgggcatccagctccggcgtaagctctgcgatccgctcccagccgcctccgagtatgcggtagttcagcagggtggaaaagtcgtcgggaaaaacggggatttcttctttaaaaaggcggaaggcaggttcgggaaccatggagcgcagcgccgccggcatatccccggggccatttgccgatgcaggccccttcgcagattcaaccagcgcgcggatcgcggatgcggaggccatacctgtaaagcactccgccttctccggcagcagcgcggtgtcatggtatgcctgtccttccctctgtattgtgtaaaaatcaagtgggctgtgaaacatcattccggccttgatatattcaatgccgagggtattattcggcgaattcaggatttcctgttcctcttcatccaaaaaggacagaagggcccggtgccttgcctcgggaaatgtcattccattcttcaggtaagttctcagagcctctttgaattgtacaggttcatccgaaagcaatccggcaatcttggtgagagctgcgatatcgccgcattcacttccaaagcagacggagtcaataccgagggccgagaacagagcgatgctgtaggaggcaaattccatcgcggatgcggtggaaaaggacaccggcatctcgacgacgagatcggctccggctgagagagctgcggcagtccgcacatacttatcgtaaatggccggggcgcctctctggacatagctgccgctcatgagcgcgatacagtaatcagagcctgtcacttctttggattttctgatgtggtacaggtgaccgttatgaaaggggttatattctgtgatgagtccggtaattttcatattatttcctgcttttttgagttttcctgatggatcgtgtaaccattttttacaatcgcaatgtgttaagattgcgcaaaggcttatagccgctctttgttttggttacaattatataggaggaagtaaattccgtaaagggtaatgttcggttaaaaaagaaacaagcctgttaaaaaaataattaacccgaaaatggaaattatctcttgtatacaataaacaagtggtatataatgttagcagaataaagaacacacacacttatgaaaggggttttttaaccatggcatttattgatttaatgaaagaaaaagcaagacaggacaaacagaccatcgttttaccggaaagtaaagacaagagaactctgattgccgctgctcagattttagaggagggcacagcagacctgatcatgattggtaaagaggaaaagatcctggatggtgccggttggttggaagttgatctgacaggaatcaaggtagtagacccggatctggatccaaactttgctcattatgcggaaaccttatttgaactgagaaaacataaaggaatgactcttgaaaaggcagaggaaattctgagagaagattacattacctacggcgttatgatggttaaggagaagattgcggacggtctggtagccggagcatgccatgctacggcggatacattaagacctgctcttcagattttaaagacagcaccaggcacggagcttgtttccggtttctttatcatggatgttccggactgtgaattcggcaataacggtacattcctgtttgcagactgcggactcaaccaggatccgacagcggaagagctggctgccatcgctgactccagcgcaaagagctaccgcgctctggtgggagagaagccggttatcgccatgctttcccactccacaaagggaagcgcacatcatactctggttgataaggttgtcaaggccaccgaaattgcccatgagaaatatccacagcttgatctcgacggtgaattacagcttgatgccgctatcgttccggaagttgctaaatccaaagcgaaagacagcgaagttgcaggtcatgcaaacgttttgattttcccgaacctggactgcggaaatatcggatacaagctggtacagagacttgcaaaggcggaagcttacggtccgatgttacagggtattgcaagaccggttaatgacttatcccgtggctgctctgcagaggatattgtcggcgtggtagcgctgacagccgtacaggctcagatgtcataattcagaccgtctggccgcgccgcatcttaaatgttcgattttgaggcggcaaataagttaagagtttatggaaaagtgagaggaagaaaaaatgaatatattagtaatcaactgcggaagctcatctttaaaatatcagttaattaattccgcatcagaggaagtactggcaaagggactttgtgagagaatcggtatcgacggtaagcttacttatcagccggagggcggagagaaagaaaaatccgacgtttccatgccaactcataccgaagcgattgatgctgttatcaaagcgctgaccaatgagaagacaggcgttatcaagagcctttccgaagttggcgcagtcggacaccgcgtggtacacggcggagaaaaattcacctcctcctgcatcatcaacgaagagtcaatcaaggcgattgaggagtgcaatgatctcgctcctctgcacaatccggccaacttaatcggaatccgtgcctgccaggagctgatgccgggcgtaccgatggtagccgtatttgataccgctttccaccagacaatgccggagaaagcatttatctatggccttccatatgaatactatgagaattataaagtaagaagatacggttttcacggaacctcccacagctatgtatccaagagaacggcagagattatcggaaaaccatatgacgaaatgaagattatcgtctgccacttaggcaatggtgccagcgtatcggcggttgactgcggtaaatccgtagacaccagcatgggccttactcctcttgagggtcttgttatgggaacgcgttccggggatattgatccggcgattctcgaatatgtgggaaagaaagagaacaagaacattgaccagcttatggaagttctgaataagaaatccggactgctcggaatctcctgcctgtcaagcgacggacgcgatctggaggatgcggcggcagaaggcaatgcgaaggctcagcttgcacttgacattttcgactacagggttatcaaatacgtaggcgcctatgcagccgttatgaacggtgtcgatgcaatcgcatttacggccggtatcggtgagaacaacaaggagctgagaaagaacgtatgtgcaaacctcggttacctcggtgttaaaatcgatgatgagaggaacaatgtaaggggagaagagagaattatctccaccgatgattcaaaggtaaaggttcttcttgttccaaccaacgaagagcttgcaattgcaagggagacacttgcgttagtaaaataatgacggaaagtccgcagagcgtacttttcgcagccggctgctgaaagaaggacaggcagagcctctggagttttcaaggctctgcctgagtccggctttcggaggagcgggtaattaaaaacctcattttagggcaaggctgtaaacatcaataatttgtcgaaaatttggaataatatacaaaataagcattgacaaacatgaaagcgctatgtataatatcatagtgcgtattaggagattagtatgctgattaatttatctgaactttttacctgtgaaggaaaaagaaaggtttatacggtatcatttgaacttggatccattgaattcggcggtgacatctataagattgtcaaagcagagccgtttgagctggagatagccaatattggcggaggcaaaaaatacacgatgtcgggaggactttccgtcactgtggaagcgccgtgcgccaggtgcctggaaccggtaacttttgtctgtgaactcgtttttgaccgggagttggatcttggaaagaaagaggagcaggaggatagtttggatgaagagccgtatttaagcggttatagtctggatgtagaccagttggtttgtaacgaactgctactgagcttgcctatgagagtcctgtgtagtgaagactgcaaagggatttgcaatagatgtggaacaaatctcaatattgggacttgtgcctgtgacactaggtcgctcgatccacggatgtcagttatccaggagatttttaatcaatttaaggaggtgtaaccatgtctatatgtccaaagaacaaatcttccaaagcaagaagagacagccgcagggctaactggaagatgagcgctccaaacttagttaaatgcagcaaatgtggcgcattaatgatgcctcacagagtgtgcaaagcttgtggctcttataacaagaaagaaatcgttaaagtagaagattaatttttagctgtgagctaagttgaaagatttagtaaatcaaggcccctgagatacctctcaggggccttgattagttggcctgttaaaagccgtatccccggcgtatctgcccggcacaaatgattgatgtatctgctgaataatggtatgatattcgaaacagtaaaatacacggatatccaacaggagggcataccacagacggcggcgggcctgaccgccaatttcctgctgatgagattttgatggctcaaacagagcttataaagatgacggtaagacaggagggaaagttttaaatgacagaacaatatacagaatttcaaaaaagagcaatcgagagcgtaaaacgcatatggagactctatgtcgtcaatctgaagcctgaggagctggaatccagctttcgcatgcttcctgaggattttctgatgattggcacgggccgtcacgaattttacaaaaacagggacgactttttaaaggggatgacggcagatcaggtggaggccagggatatccagtttgaattgcaggatgattggtatgaggcgcagcggataaccgatgatgtatgtctcgtctatggagggatttggatccgtgagaagtccacaccgggaaagccggttctgatagatatggagggcagccggtttaccgttgtctgccgggacactcccggcggcgtgcagatttgcaatgttcaccattccatgccgtatctggatcagggagaggatgagtattatccgaaatctcttgcatccctggcaaatgaggccgtacaaaagagcagggcgctggaacaccggatggaactggaccatatgacggagctttataaccggatctatatggaacggcacgtttcccgggcaatcaaaaatgagaacggttattttctggccattgatttagacgactttaaatgtgtcaatgattctaaaggacatttaacaggggatgaggtaatcagggaattttcccgggttttgaagcggtcattttctcctgcggcaatccttggacggatgggaggcgacgaatttgccgtgtgggagagctgcagtgcagactatgatgcggtggaaaagcaatttctcagactgttaaaggaatgcagtgtgctgtcggagcggttgcacgtatctgtaagctgttctgccgggatagccggaagccgcaggacaggggaagattttacggcgctctacaacagggcggacaaagcgctgtaccgtgcgaaggggcaggggaaaggcgttgtctgccgggcagaggaatttgaataggataaggaataaattatgcaaaagcatgttatgaagctgttttcacagcctacggctgactggttttccgatacgttcggaatgccgacgagagtgcaggaggaggcatgggccgcgatcgcaaaggataaagatgtcctggtcagcgcgccgacgggaacaggcaagacactctctgcttttctgatcttcatagaccgtctgaatgcgctggcggccgggggagatttaaaagaggagctgtatctgctctatgtatcgcctctgaaatcgcttgccggagatatccgcgagaatctgcgccgtcctctggacggaataccgaaaaaagcagggcagccggaaattgtggcggccatgcggacgggagatacgccccagaaggaacgccaaaggatgataaaacaccctccccacatcttgatcacaacgccggaatcactttatctgatgctgacgtcaaagggagggcaggaaatactcaggacggtgagagcggttatcctggatgaactgcatgcaatgattgatacgaagcggggagcgcatctgatgctctccattgccaggcttgagaagctgagcggacgaaagctccagcggattggattatcggccacaattgaaccgcttgagctggcggcggagtatttgtcaccggagtctgccgtcattgctgctccgccgatgaaaaagcaggtaaaaatagagattgtgggcaccgtgccctttggggaaaagcgcaaagatcctctatgggaggagctggccaagattgcctatgaacaatgtctctcctataaaagcgtgattgcattttcggaggggcgccgctacgcggaaaagctggcttattatgtgaatcttttgggaggggaggactttgccagggtccatcacggcagcctgtcaaaagaacagcggatggaagcggaagaggcgctgcgaaagggaaaactccgccttttgtgcgccacctcctccatggagcttgggattgatgtcggtgaaatcgaccgcgttctccagattggctgtccgcgcaccgtatccagcacaatgcagcgtctgggccgtgccgggcataatccgggcaaggtgagcgtgatgacgatgtatccgcggaccgcgccggagagcgtatattgcggcataacggcggagattgccaggcagggcggcgtggagcatgcggccccgccggcaatgtgccttgacatcttagcccagcacctcgtttccatggctgtgggagacggctattcggtggacgacgtcatgggaattttgtgccgggcctatcctttccgccgcgtgacgaaagaggatgtgagggcggtactgcgcatgctggccggcgattacgagcacagccgcgaaataccggtccgcccccggatactctatgaccggattcacgatcgggtgacgggggacaattacagccggatgctggcagtggcagccggaggcaccattccggacaaggggctttacacggccaagacggaagacggggtgaagcttggagaactggatgaggagtttgtctatgaatcccagattggcgaccgctttttactgggcgccttcgcatggagaattatgaggcaggacaaggatacggtatacgtggccccggcgcaggtggagggagccaggctgcccttctggaaaggggagataaagggccgggcgctgcgcaccagccgggcctttggccgcatcatgcgggagctggaaaactgtgccgaagactcggaggaaagtcttttaaaagagctttaccgtctgggtcttgatgagacggcggctgaaacggcttccggctttttgtcacggcagattgaggcgaccggagggctccccgacgataaaacggttctggtggaacattttaccgaccacacgggaaactgccaggtcatggtgcatgccctcttcggaaggagggtaaatgcgcccctgtccctgctgctccggcatgccgccggtgagcagagcgggatgaatctcggatgtgtggatgacgacgacggggttctgctctatagttacggaggggaaaaactgccggagggcctgctgtaccagattaatccggatacggtgaagcctgttttggaagcagtgctgccgctgactcccgttttcagcatgacattccgttacagcgccgccagggcgctgatgatggggatgaggcaaaacggccgccagccgctgtggatgcagagactgcgcagtacggaaatgctggattccctgatgggggagagagaacaccctctgatgcgggaaacacggagggaatgtctggaggatttatgggatatcggcggcgtgacggaagttttaaacgaaatccgctccggctgcataacggtccgtgaggtgtacgtcgatgtgccgtccccgatgtcccttcctttccagtggaaggtggagacagaggagatgtatgaatattcgccttcaacgcccggaatccgtcaggcggcatatgaggaactgagacagatggagcggatgaaaccatccgcagaggagctggcccggcagcaggaacggaagaaactgccggagaatgaggaacagctccactccctgctgatgatggagggagacctgactgcaggagaacttccggtcccggtggagtggctggataacctggccagaagggaacaggctctttatctggagccgggactctggatagcgatggaacagagggaagagtatgaaagaatgcttgccggggaagcgggagcggaggaaccgggctgccatatagtgcggagaatgctgtattaccgcggaggacagaccgaggatgaaatacgggaacggtacttcctgacaaagccgtttacaaaaaagcttctggaggagcttcaaagccgggagagcatcgtaaaggacggggaagtctattaccattccaggctgtatgaccgggccagaaatagaatggtaaagagcctgcgcctccagacggtgacaagaccgcctgagagctacgcctccttgatggccgggcggatagagctgcatgccccggcagaggaacagctgaaacgcgcaatggaacaatgctgtgataaaaatcttccggtcaggcagtgggaatccgtcattttcagaagacgcgtgaaaaattattcggagacaatgctggaccgccttctggcccagggagattatttctggaagatggcgccggatggaaacttgagtttccaccgatatgacgatatcgactggggcgccggtctgccggaggcggcagaggaactggaaggggacgaactgcttttgtaccgggagttaaaaaggcgcggcgccagctttcttaaatttctgacgggaattccaaaggaggacagcgcccaggaggtacttctgaaactggctgccaaaggcctcgtctgtgccgacagctttgtgccggtgagacaatggcagaacagggagaaaatcaggaaagcgccggtcagacagcgtgttaacgcaagggtcatggcgctgtcggccgggcgctgggatattgtgcggcccgtccgggaaaaaagcagggaagaactgcttctgcggtatttcacagaggcagttgttctatgccgggaaaccttcctgaaagcctctatgggggatgaatttacctggcgcgaggcgctggaaatcctccgcgtctgggagtacacgggaagagtcagaagagggtactttatcgaagggctgtccggagcgcagtttatcagaaaagatgattacgaggcggtcaccgctttattacagaagtccgatgaggagcttatatggctgaatgcgtcagacccggcacagatttggggcaaaattttaaagcagccaaaggaacgggaatttatgattcttccgggaaccgcagttgcgctgctgggcggacttccggcggcagttcttgaaaagcagggaaaaaccctgagagttttcggggatgacgcacaaagcaggctggatatcatcctgtccggactggtacgggatttcagggaaaaaaagctgttcgcggaccaaaaacggctgattgtgaaggattatccaaaatacgccggagacagcctgaaaaaagcaggttttattcacgaaatgcaggactatgtactatattggccgtaaaaatgatatggacagcgcagaggcaatacggatataatttaaaaggccataagacctaatcgtggtcttatggcctttcccaggggaagccgctaaatctttacatcagtttcagttaaacgcgttctatcagcctccaaagccctgtacaaaggtcttgatgaaccagatagtggttggctgataaatgatatcaaccaggaaagcgcctacgattggaacgatcatcattgctcttctggacatgccgtaacgctcgtttacggcagtcatgttaacgatagcggaaggtgtggctccgagtccgtgtccgcataaaccggcgcacataacagcagcgtcataattcttgccgaggatacggaatacaacgaagtatgaaacaagaatcataaagattacctgagcgaatacaacgattgccactccgccgatgaggcccgacagttcccagagcttcagcgtcataagagcaagggagagatagaggcttaacatgacatcgccaattccctctaccagaggatagttgaaattgtacattctgaatttctcattcaggttacgcaggataacggcaacaaacatggctccgacgtaagttgggaaggacatgctgatcagtccgctgacccatttggagaccatggttccgagcgccatacaaacgagaatagccgtcacgtttttgatgatatccagaccggaaagcttctcgccggtatcggcgttgatgctctctacatcggtcgcaaagttttcattctcatccggttttaaattgtatttgacgatcagacggcgtccgaccggaccgcctactaatacggctgaaatcagaccgaaggtggcagccgcggcgcctactaaaggagccgtctcataacccatctctgcgaacgtgctgccgtaggataaagcagcgccgtgtccgccgatcatcgagatggagctggagagaagcgcatagggagcttcaaggccgatcactttagaaatgccgataccgattgtgttctggaaaatggagattactccgcaggtgagccagtatacaatcagaagcacgccgccctttttcagcagggcaaagcttgcaccaagtcctaccgtggtaaagaaagccagcatgaaaggatcctggaatgtgttggtaaagttaaaagtaaagcttccggtggcatgtccaatccatgtaataaacataaaaaggaatccgccgactaccggagccgggatacaatacctgtcaaggattgtaagtttgttcttgataaaatagccgataaccagaaggacagcggccatcgccagcgtcataatagcatcggtgttaatgttgagaacattttcaatagtttcaaacgtcattctacctacctccaattttgaaattctggtgtacttacttaaatttataagtgtcttatgtacatcaagctgcaattgtttcccttcccctgtgaagaaataataaaaaccggtattataatccatataattatgtataataataccagtcagcctgatttcattataaaatatccggccataaagcacaagatacttcgttagtattaagaggggaatgacggtaattttgttaaaaaaaagtaacagttgaatcgccaagaagaaagcggagcaaaaaataagtattaaagtgtaaacaattaaaataacaatttacatgaaaagaagaatgtgatataacaaaaaatggaaaaaggcaggccggatttccccacagagataaaagcgctgttttatggcaggtatcaatgccgttttacgccgcataacccggaagtttcgcaaaaaacagcgaaaacaccacgcggaatgcattatggcagaactgctgctgcaaagataccataataggaaaaatcatattgatttatagaatgatatttagtatattattgtatagattgtggcattcttgatagatggggataaacgtatgcctttatttatgtctgagaatgcgtcggcaaaggagaaattggcatgatcaaagtagcggtagatgcaatgggcggtgacaacgcaccggaggagatcgtcgcaggagccgttatggcggcgaataccagaaaagatataaaaattcttctggtcggtcaggaagaacgtgtatcagcggaattaaagaagcatacatataatactgatcagattgaaattgtaaatgcaactgaagtgattgagaccgaagagccgccggtaaatgccatacggaagaaaaaagattcttccattgtggtagggatgaatatggtacgccgcgatgaggcggatgccttcgtctcagcgggaagttcaggtgctattctggtaggcggccaggtaatcgtcggaagaatcaagggagtggagcgtcctcccctggcaccgcttattccgacggagaagggagtgtccctcctgattgactgcggcgccaatgtggatgcaaggccgtcccatctggtacagtttgcaaagatgggctccatttacatggagaatgtggtaggtatcaggaatccgcgtgtggcgattgttaatatcggagccgaggaggaaaagggcaatgcactggtaaaggagacgtatccgctgcttcgcgaatgcggggatattaattttaccggaagcatagaagccagggagattccccatggagaggccgatgttatagtcgctgaagcgtttaccggcaatgtcattctaaaactgtacgaaggcgtgggcgcgacattgatagccaaagtaaaggccggtatgatgaccagcctgcgttccaaaataggggccttgttagtcaagccggccctgaaggaaacgctgaagagcttcgacgccagccagtatggaggagccccgctgctgggactgaacggcctggtggttaagacccacggcaattcaaagcggacggaagtatgtaattctataatccaatgcgttacattcaaagagcagaggattaatgaaaaaatgaaagagagccttttcccgaaggaaaaggaacaagaagaaaggtgagagaggaaggaagactatggaatttgaaaaattacagcagatcattgcagaggtattaaatacggagccggacgagatcacaatgaacacgacgtttgttgacgatttgggggctgattcacttgacatctttcagattatcatgggcattgaagaagaattcgatattgaaatcccgacagaatccgcagagaagatcgtaacggtacaggatgcggtagaacagatcaaaaatgcattaaattaataaaggtttgccggagcagccctggggacggggctgcttgtgttattgttcacggcactgactcaatacagcccattaaccgggcggaaaggaaaaatatggacaaaaaactgatggaactggaagaaaagacaggctatcatttcaacaacagagagctgctcggccgtgccatgacccacagctcctatgccaatgaatgccacaaaagtaaattagagtgcaacgagcggctggaattcctgggagatgccgtactggagattgtgtccagtgactttctgtttcacaaattcccggacatgccggagggggatttgacaaagactagagccagcatggtttgtgagcctacgcttgcctactgcgcggaggaattgtcactcggtaaatatctgctcctgggaaaaggagaggaagcgaccggaggaaggaacaggaactcagtagtttccgatgcgatggaggccctgattggagccatttatctggacggtggttttgctagtgcaaaagagtttattcacaaatttattctgaatgatatggaacataagaagctcttttatgatagcaagactatcttgcaggaaattgtacagagccggtgtgaggaagggctcagctaccagcttctcagggaggaaggcccggatcataataagatgtttgaagtagcggccaaaattggtgagaaggagattgggcgcggtacaggcaggacaaaaaaggcggcggagcagcttgcagcctaccgcggtatactaaaaatcaggaaatcataggtggaatatgtatttaaaaagtattgagatccagggattcaagtcatttgccaaccgaatcctgtttgaatttcataacggtatcaccggtatcgtgggaccaaacggcagcgggaagagcaatgttgccgatgcggtccgctgggttctgggagaacagcgtatcaagcagctgagaggcggctcgatgcaggacgtcatattctcaggaacacagatgcgcaagccccagggctttgcctatgtggcgattacactggacaattccgaccataagctgccaatcggctttgatgaggtcaccatttccaggcgtctttaccgctccggggagagtgaatataagattaatggcagtacctgccgtttgaaggatatcaatgagcttttttatgatacgggtatcggaaaagaggggtattccatcattggccagggccagattgacaagattttaagcgggaaaccggaggaacggcgcgagctgttcgatgaagccgcaggcattgtcaaattcaagagaagaaagctgattgcacagaagaagctggaggacgagaaacagaatctgctgcgcgtttccgatatattggcggagctggaaaagcaggttggccctctggccagacagtcggaggcggccagggaatatctccgtctgaaggagagtctgaagctctacgatgcaaacctgttcctgacggagtcggagacccttaagggccagcttaccgaaattgaaggaagagaagttgttgtaaccggcgatttggagactgtgagaacggagtcggaacgtcttaagacggaatatgatgagctgagccaagaactggaagggcttgagaacctgattcaggaagagcgtgacgctatgagccgggccgtactgatgaaagagagcctggaggggcagattaacgtcctgggcgagcagatcaacacggagcggatgaatgaggaacatattaagagccgcatcagctccatagagaatgaaattgcggcgagaaccagccggaaagaagagtacgaaaaggagcgggaggaactgtcccgcagtatcagggaagtcgccggggaactgtcctgtgcggaaaaagagctggcggaaaaagagcaggaaattctggactttgagacgctgacggaggatgccaaagcggaaatcatacgcgctctgaatgagaaagccggcctggcagccaggcagcagcgctatgcgaccatgcttgaacaggtggatgtgcgcagggcggaagtcagccaaaagcttttgaagtttaaaagtgacgaatcaattcaggatgagcagattaaggaagaggaaatccgccttcatgagatagaggcacacctgacggagcttgccggacgcgaaaacgcgctggtatcggaggctgagggtgccgacgaagaggtgaaacggctgggaaaacggctgaacttcacacagcaggagtatcataaaagctacacaaagctggaatccttaaagaatctggcagagcgctacgacggctacggcaacagcatccgccgcgttatggaggtcagggatcgtgtggtcgggatacacggcgttgtggcggatattatttccacgacaaaagaatatgagacggcgattgagacggcccttggcggaagtattcaaaatatcgtaaccgattcggagcagacggcgaaacagctgattgaatatctgaaaaaaaataaatacggccgggccacatttcttcccctgacgagtgttgctgacagaggttcctttaatcaggaaagcgcgctcagggaaccgggcgttctggggcttgcaagtgatttggtgacggtggataaacagtaccggggactggccggttatctgctgggccgggtgattgtggccgatcatattgacagcgccattgcactggcgaaaaaatataaacactctatgagaatcgttactctggagggcgaacttctgaatgcaggcggctccatgacaggcggagctttcaaaaacagcagcaatctcctgggcagaaaaagggagatagaggagctggaagaaaactgcgggaaagcgcttgtgctggtggaagagatacaaaaagacctggcgctgaatgaaggaatactggaagaagcaaaaggggagcttgagaaaatcagggctgagaaacaggccgcatacctggaagagaatacggctcagatgaacctttcaagaatggaaggaaaaaaacgagagattgtggaatcttctgcagatctggttgctgagaaccgagagctggaggaacagttaaaagaactgaaggagaaccggacccggctggaggaagaggcgggacgtctggaagacctgggacttttaaaaaaccgggaagtggaagaatacacagtcaggctcgagatactgaaagaggagagggagcagaaggcgtcggctctttctcaggtgcagcttaaggcggcccaggtaaagcagcaggacagctttactcttgagaatataaaacgcgtccgcgaagaggctgaaaagctgttgcttgaaaaagaagagctgacggcggggggaagcggcagcagccaggctattgagaaaaaacaggcggaaattgaaagcctgagggcacagatagaagaggctcttagcacggccggaaaactggaacaatccatggccgggaagataaaggataaagaagaaaaaaccggcaggcagaagtccttttttgataaaagggaagggctttcggagcggatgaaccttcttgataaggatttgttccgtcttcagaaccagaaggaaaagctgtcggaacggattgaaaaccagacgaactatatgtggagcgagtatgagctcacctggtccactgccgaaaagctgaggcaggaggagttaaactccgtaccggagatgaagaagcagatagagcagttaaagtcacagatcagggcacttggcagcgtcaatgtcaacgcgattgaggattataaagaagtatcggaacggtacgaatttatgaagacccagcatgatgatctgattatggctgaggagacgcttcttaaaatcatcgatgaactggattccggaatgcgcaggcagttcgaagaaaaattccgcgaaatcaggatggaatttgacaaggtattcaaggagatgttcggaggaggccacggtactctggagcttcaggaggatgaagatatcctggaagcgggaatacagattatctcgcagcctccgggcaaaaagcttcaaaacatgatgcagctttcaggcggagaaaaggcgctcacggcgattgccctgctctttgccattcagaacctgaaaccatcgcccttctgccttttagacgagattgaggcggcgctcgatgatttcaacgtggatcgttttgccgggtatctgcataagcttacaaaatacacacagtttatcgtcatcacccaccggaggggaaccatggtcgcctcggatcgcctttacggtatcacgatgcaggagaagggcgtgtcaacactggtttccgtaagtctgattgaggataaactggaagcatagtaacagttcattctgtctgggctgctacagcataatgtacataagacggaccgcaacgcaatctaagatgcaggaaataatcgtaaccgcaatagtattttaaggaggaaactggagatgagtgaaggaaaaaagggctttttcggccgtctcgtagaggggcttacaaaaaccaggaattccattgtatcgggaattgactcgattttcagtggcttttccgccattgatgacgatttttacgaggagatagaagaaacgctgattatgggggatttgggaatccagacgacgatgtcgatcgtggaggatctgcgccggaaggtaaaagaaaaccatatcaaagagccgtcggaatgcaaggatcttctcgtggccagtatcaagagccagatggatctgggggaaaacgcctatgaatttgagagacaaaagtccgttgtacttgtgataggggtaaacggtgtcggaaagaccacctcggtcggaaagctggccggccagttaaaggatcagggcaagaaagtaattcttgcggcagccgataccttccgcgcggcagcgattgagcaattgacggagtggtccaaccgtgccggtgtggaactgatagcccagcaggagggctccgatccggcggccgttatctttgatgccattgccgccgccaaatccaggaatgcggatgtattaatctgtgatacggcaggcaggctccataataagaaaaatctgatggaagagcttaaaaagattaaccggataattgacaaagaatatcccgacgcctaccgggagacgctcgtagtcctggacggcaccacgggccagaatgccctgtcccaggcaaagcagtttatggaagtagccgatattacaggtattatcctgacgaaactggacgggacggcaaaaggaggtatcgctgtcgcgattcagtcagagcttggaataccggttaaatacgtgggaattggtgaaaaaatagacgatttacagaagtttgacgcaaatgattttgtaaacgctttgtttaaaagaccggaggaaaaaacagaatgagcggggaatacgaagagcaggtaaaaggagaaaagatggaagatatggaagagaaggaagaaaaattgacgctggagaaatttgaggaggcaacggaagccgtttcaaaggtaatatccgagacaaagctggtgtacagtgagcatttttccaatatgaccggtaacaaggtgtattttaaacctgaaaatatgcagtatacgggagcctataaggttcggggcgcctattacaaaatcagcacgctttcggaagaggaaaaaagcagagggctcatcactgcttccgccggtaatcacgcacagggagtcgcttatgcagcgaagctggctggcgcgggagccgtgatcgtcatgccgaccacaacgccccttatgaaggtcaacaggaccagaagctatggggccgaagtggtactccatggagacgtatttgacgaggccctggcccatgccaacaggctggctgccgaaaagggttatacatttatccatccttttaatgatctggatgttgccacaggtcagggaacgatcgcgatggagattatcaaagagctgcccacggtagattatattctggtaccgatcggcgggggaggcctctgtaccggggtggcaactctggcaaagcttctgaatccgaagattaaaattatcggcgtggagccggcgggcgcaaactgcatgcaggaatcccttagggccggaaaggttgtatcccttccttcagttaacacaatagcggacggcactgcagtgcagaccccgggagaactgctgctcccatacatacaggagaatgtggacaaaatcatcacaatcgaggattccgagctgattgtcgctttcctcgacatggtggaaaaccataagatgatcgtggaaaattccggccttctgactgttgcggccctgaaacatttgaatgtcaataagaaaaagattgtttcgattctgagcggcggaaatatggatgtaattacgatggcttccatcgtccagcacggcctgatccagagggatcgtgttttcacggtttccgttctgcttcccgacaaaccgggcgagcttgcaaaggtttccactcttatggcggcagagcaggggaatgtcatcaagctggaacacaaccagtttgtcagcatcaacagaaatgcggctgtggagcttcggatcacggtagaggcattcggaacagaacataaagagaagattgtagatgcgctgaaagccgccggctaccgtccgaaacttgtcaaatcaaaaggaatctatgaggcatagactggattaaaacggcggtccttcgcggatggtatcagggtgcggatgtgaatcatgaagcggagaaccgcagttaaaaaggggaaatgggtatgtatcaatttgacaagaatacaccgtttggcaaaaatctgcattactttgccaaatggaccgtgatatccgttctcatcggactggtaacgggactggttggaactgttttcggccatgcagtgctatgggtatcctcgtatttcaggaataatccatggacgatactttttctgccggtctgcggacttttgataacgggtatctaccatattttgaaagaagataaaaaccgcgggacaaatatggtaatcgaatctatccattcgggcacggaaatcacctttggcacggctccggccgttttcctgggaacgcttctgacccatatcagcggcggttcctccggccgggagggcgcagccctccagttggggggaagcatcggaaaccagattggcaaggtgatccgcctggacgaaaaggatatgaaaattgcggtcatgtgcggcatgagcggggcttttgcggctctgttcggaacgccgatggccgccgccgtgttttcaatggaagtaatcagcatcggcgttatgtattatgcggctctggtgccctgcattttttcttcctttatcggagccgcaatcgcaaaacatatgcagcttatgccggaggcgtttgccatcggggaagtgcccgcattcgatttgaaaatggctgtaatcataattattctcgggatgctctgcgctctcgtggctgagctgttctgcatcacgctgcgagggacggagcatacgttcgtaaggcaccttccgtcaccggctaagcggatattcgtgggagggctgcttgtaatcgccctcactctgatgtcgcggacaacggcatataacggaagcggtatccgcctgatcgaaatgtgcttcgaaggagaggtcgattacgctgctttcctctggaagataatttttaccgccattacgctggaggccggttttaagggaggtgaaattgtccccactctgacaatcggagcaacctttggctgtacctttgcgatggtgacgggccagcctcacgggctgatggccgcctgcggaatgctggctctctttgtgggggttaccaactgtccgatttccacgctgttaatagggtttgagctgttcggctactcggcgatgccgtattttgttattgtaatcgcggtcagtttcactctttccggctactacagtctttactccagccagaaattcgtatattcgaagactaaaacagaatttatcaaccggaagacgaacgattttatcccataccagagaaagaagattacatcacctgaggaataggggcaataagccccacagcccaaacggaggaaactgcaataatgaaaactctaattcgaaacgccacagtcctcacaatggataaggaaatgcacatttattccccgggctatgtgttgaccgtggatgagacaatcaaagaactgggatacgagagtgcagctcttccggatgcagacgaggtaatagatgccggaggaggtattgttctgcctggatttatcaacacccactgccatgtcccgatgatgccgtttcgctcactgggcgacgattgtcccgaccggctgcgccgcttcctttttccgctggaaaatgaagccatgacaaagaagctggtgaagctgtcttcaaggtacggcatttctgaaatgctgctggcgggtgtgactgcttttaccgacatgtattattatgaggaggaagtggcaaaggcctgtgaagagctgggcatccgcggagtcctcggtgagacggtgatcggccagaaaacgtgtgacagtgaggagccttacggagggcttggcctggcggaagcatttataaaggagtggaaggggcatgaactggtcactcctatcatagctccccatgcgacaaacaccaacagtccgcagatgcttaaaaaagcatatgatatcgcagaaaaatacgatactctctgcactctccacgccagcgaaatggattatgaattaacttattttcaggagaagtacggccggacaccgatagaatttttagaagcaacaggagtactgggcagccgtctcctggcggcccactgcattcatctgaccaaagaggatatcagactgctggctgccggcagagtttcggtcagccactgtatcggttccaacacaaaagcaggcaaaggcgtcgctccggtcagggagcttctcgaagcgggaatcccggtcggccttggaacggacggggcctcctccggaaacactctggatctcttcatgcagatgcgtctgttcgcctccttccataagacggtgaaccatgacaggagtgtatttccggcaaaggagattgtgagactggcaacctgtgaaggagccaaagccctgcacatggaaaagacagtcggttcactggagcccggtaaaaaagcggacattattcttgtagagacagattccgtcaatatgttcccatgctacgatccctattcagctctcgtttattcggccaatccctcgaatgtggatacggttctcgtaaacgggaggatcctggtgcgcgggaaaaagctgaggcatgctgatttgagatgtatcagagaggaattggatgatgccatgggggcctttcgcagggcggcaggaaaatggagatttagttaagcaggtgaggacgccgccggtatggccggtggacgggggtggggtgtgtatatgagtctttcgtcccgggggttttgcatcgctggatggagaaggagatactgtggttttgttttcgcagggcggagccggagagaatgatatccggctggactgcttcttcgagggatagctctaagacagaggaaggcaaagccccccggggttacggacaaattcgctccgaactccgaatgagttcgaagctcaagttgtcccggattttgcccttgtagggctaaaatccgcccggcgcgctttgtctccctctgcctaagagctatcgtctctcgggcgaacgtccttccggatatcattctctccttctccgccggaagatgtcggcagtatctccttctcccggaaggttttcgccggaacgaaagactccgccgggtgtatcggccccgtccgctggcctgcggccgctgattgtctcacgcgttaagtgtgggggcggaccttgtcgaggccaatcagtgcttctgtgtacgagaaatacgatatgtcttcaatgggctttttaaaaaaatggcggaagattttgatatcggcctgccggaaacacatagtagccgcgacaaggctctccccatttaaggttagagacaatcagctgccggaacggaccatgtccggtgccgcgaaaacctccgcctgagtcttttgccctcggcgacaacctgaccaggggaagtaggcggaatcaattgcggaggggacatgggagtccgccggtgcttagcgaggtccctcacgagcttagcactgctgcgcactccaaagagtgcaaacggtccccgcagcaattcgttccggccggattccccccttacgacaacctccaaccggggacaaaagactcagcccagcctcctcaccataccggacatggtccgttccggccgcgtcctcctaacctccgttaaatattaatttatgaaatttttatcgcacaatcccatcttttgtggtagaataacaatgttaaagtatggcatagaaaattatgccgtttacaactaaatacacagggagaaagacctattatggaaatgaaacgagtattgcttaaattaagcggtgaagctctggcaggcgataagaagacgggctttgacgaagcgacggtaaaggaagttgcccgacaggttaaaatagcagtttccgaaggcatcgaagtcggtgttgtcatcggaggcggaaatttctggaggggccgtgagagtaatgccattgacagaacgaaagcggatcagattggcatgctggctactgtcatgaactgcatctatgtgtctgagattttccgaagcagcggaatggacacacagatcctgactccatttgagtgcggctccatgacgaagcttttttccaaagacagggccaataagtactttaagagagggatggtagtgttttttgcaggcggtacaggccatccgtatttctctaccgatacaggagttgccctcagggcgattgagatggaggcagactgtattcttttggcaaaggccatcgacggcgtttacgacagcgatccgaagctgaatccggctgcgataaagtatgacacaatttccattcaggaagtaattgataaaaagctggctgtagtagatttgacggcgtctatcatgtgcatggagaatcatgtgccgatggcggtattcagccttaatgaggaaaacggcatcatcaatgcgatgcagggaaaaataaatggtacggtagttaccgcataacaggaggtttatatgcaggagaagattaaggtttacgaagaaaagatggtaaaatcatatgaagttttgttggatgagtatgcctccatccgggcaggcagagcaaatcctcatgtgcttgacaaactgagagtggattattacggcacaccgactccgcttcagcaggtagctaatgtctccgtaccggaaccgagaatgattttgatccagccatgggagagaaaactgatcaaggacattgaaaaagcaatcctcacctctgatctgggcatcaatccgaataatgacggcaatgccatccgccttgtcttcccggaactgacggaagagcggagaaaagaactggcgaaggatgtcaagaaaaagggagaaggcgttaaagtagctgtccgcaatatccgccgtgatgccaatgatgcgatcaagaagatggagaaggcaggagaaatttctgaagatgatcaggctgaaggcgaggagaagatccagaagattacagacaagatgatcgagaagattgataaagcggtagaggcaaagacaaaggaaattatgaccgtttaatcttttcggttcggagagatttaaccgcataacagggggcaggtaatctgcccctgattttacgttaattgacggtgagaggctaaacacacatcggaggaaatgatggaaaatacagataaaattataacagaggagacgaacctggttattccggaacacgttgccctgattctggacggcaacggccgctgggcgaagaaacgtggacttccgagaaccgcaggccataagcagggctgcgtgacagtggaacagacggtggaagacgccgcgagactgggtataaagtatctgaccgtgtatggtttttcaaccgagaactggaaacgctccgtcgaggaagtgggagcgctgatgcagttgttccgttactatctgaaacggcttttaaaaattgcaaaatcaaataatgtcagagtgaaaatgatcggggacagaacccgtttcgatagagatatcattgaaggaatcgatacactggagagagagacaaaaaataatacgggaatgactttcgtgattgccgttaattatggaggaagggatgagatcacaagagcgatccggcggatgacggcagactgtaaggaaggccgtctcgattccggctcagttacggaacaggtggtttcctcttatctggatacggcagatatcccggatccggatcttctgatccgtaccagcggagaaatccgcctctcgaattatcttttatggcagcttgcgtacagtgagatcgttgtgacagactgcctgtggcctgatttcaacaaagaagagctattaaaggccattgcccagtataataagagagacagaaggttcggcggtgtcaaatgaaaatgaagcacgcctgaattacctcgcaggaggatggctgcaaagcggatgcagcttacgaatacctgtattgtcggcaggtgagttgagggaggaggagccatgttcagaacaaggctgatcagcggtattatactagtaattctggccgtgattgtagtcagtacgggaggtgcccttctgtacggcgtcactgcggttatttcactggtggggatgtttgaattataccgtgtaatgggtattgagaaaaaaagtctgggacttgtcggatatctggcggggatatcgtattatggcctgctgtggttcgacggacaaaaatatgtgacgttgctggcgattgcagccctgatgctgcttatgacaatctacgtgtttacgtttccccactacgggacagaacaggtgacggtgtctttctttggcatcttctatctggcagtgatgctttcctacctgtaccaggtgagggagatggcggacggaagatatctggtctggctgattttcctgagttcatggggatgcgatacctgcgcctattgcgccggaatgctgtttggcaggcacaaactgacaccggtgctgagcccgaaaaagacgatagagggagccgtgggcggaataataggggcggctgtcctcggattcatttatgcatccatattcggccacaggatggatgagattggcaatccacaggcagcttgtgcggcagcctgcgccatagcagcggtgatttctcagataggagatctggcagcctccgcaatcaaaaggaaccataatgtaaaagattacggccatctgataccgggacacggcggtgtgctggaccggtttgacagcgttatatttacggctccggctatcttttttgcgctgacatttctcggttaacgcctgacggaagggacaccaagattctgtcagacaggtacaccggccggaaaagatgcatagaatactggagccggttcaataataactgaagatatcaaaaagtaacagtgagttaagaaaggcagacatctgcgatgaaaaaaatagctatactgggttctaccggttcaatcggaacacagacattggacgtggtcaggacgaataaagatatagaggtgactgcattagccgccggaagcaatatatcgcttttggaaaatcagatccgggaatttacaccgaagctcgccgcagtctgggatgagaagaaggcggctgaacttaaaagccgggtgcgagatctcgatgtgaaggtggtaagcgggatggaaggccttctcgaaattgccgcagaaccttcctcggagattctggtgacggcgattgtaggtatgattggcatcaggccgaccattgcggcaatggaggcgggcaaggacattgccctcgcgaataaggaaacgcttgtgaccgcaggccatatcatcatgccgctggcaaaagagaagaatgtcaggatactgccggtggacagtgaacacagcgccatattccagagcctgaacggcgagcatggaaacaggatacataaaatccttctgactgcatcgggcggcccgttccgcaaaagaacgagagagcagatgaaggacattcaggtggaggatgcgcttaagcatcccaactggacgatgggcagaaagataacaatcgacagctccacgatggtgaacaaggggctggaagtgatggaagcaagatggctgttcggcgtcacgatggagcaggttcaggttgtggtccagcctcagagcgtgattcattccatggtggaatttgaagacggagctgtaattgcccaattgggaactccggacatgaaactgccgattcagtatgcgctttactacccgcagcggaagtttttgcccggcgggcggttagattttgccaaacttgggcagattacctttgaagcccctgacttctgcaattttcacggcctttcactggcctatgaggcaggaaaacgcggcggaacgctgccgaccgtatttaacgcggcgaatgaactggcagtgaaaaaattcctggacagaaaagcaggatacttagcgataaccgatatgatcgaggctgcaatggagcagcacagggtagtggaaaatccgtcggtggatgagatactttccgctgagcaggagacttatgactttatagagagcaggtggtagattgttaagtttacttgcggcaatacttgtatttggactaatcatactttttcatgaattcggacactttctgctggcaaagcgcggcggaatctgcgtagtggaattttctctgggaatggggccgagactgttcagcatggtcaaaggcggtaccaggtattccctgaaactgtttcccttcggaggctcctgcatgatgctgggagaggatgaggatttatccgacgatgacagggatgagagggcaggaaaaaatattgccggtaaagcagcttacggggaggatgagtttaaagatacaaaagccgcttcccataaggaagcggagcagacacgaagctacgcgggggtagaactggcgccgggagcaaccggagtgacatttaatgagacatcggtgtggacccgatttcttgttattgcggccggaccggttttcaactttattctggcatttgtctgtgcattctttgtaatcagctatgtgggctacgatccggcggaagtttacagcgtcgtggagggctatccggcggctgaggcaggaattgagccgggcgatgtgattacacagatcaacggcaagaacattaagatatacagggacgtactggcttataccagcttccaccagggagagacactgaacctggaatacagacgcggcaatgaacttcatcaggcggtgattgagccggtatattccgctgaaaacggaagctatatgatgggaatcagcggcggagtctataaaaaaccggaatccgtatttgtgacagccaaatacagcgcgtatgaactgaggtactggatcaatctgacgtttaagagccttgggatgattgtgaaacgccaggtaaagacggatgatatagcaggccctgtgcggattgtttcgatgatcgattccactgtcagggagagcagcgaatacgggctgatggtggtgcttgtcaatctcgccaatatgtgtgtccttttgagcgcaaaccttggcatcatgaatctgcttccgattccggccctggacggaggacggcttgtctttatcattctggaagcgctcagggggcggccgatcgaccgggaaaaggaagggatgatccatatggccggtatggcggttcttatggtgctgatggtatttatcctgtttaatgatatcagaaacatgctgtgataaagtagaagttcagagataccggggaggttagtatggcgtacagagatgagacaaaaacggttcagattggaaaaaaggtgatcgggggaggaaacccgatcctgatccagtccatgtgcaacacaaagacagaggatgtgaaagcgacaatcggccagatcctggaacttcagaacgctggctgtgatattatccgcgtggcggttccgacgatggaagctgcaatggccctgaccgagattaagaaggcaatcaggattcctttggtggccgatattcattttgattaccgtctggcgattgcagcgatagaatgcggcgctgataaaatccggatcaatcctggcaatatcggtgcaaaagaacgcgttcaggccgttgtggataaagcccgggaatacggcgtccctattcgtgtgggcgtcaacagcggttccctggaaaagcatctgctcgaagagtacggcggcgtgacggcggagggaattgtacggagcgccctggaaaaggtggcgttgattgagcgcatgggatacgacaatctcgtaatcagcatcaaatcctcggatgtcatgatgtgcgtaaaggctcatgagctgattgcaaagaaaaccagatatccgctccatgtcggcatcacggaggcgggaacgctgctggcaggcaatatcaagtccgccgttggcctgggcctgattttaaatcaggggatcggagataccatccgtgtctccctgaccggaaacccggtggaggaagtgaaatcggcaaagctgattttgcggaccctggggcttcgaaagggaggggttgaggtggtatcatgccctacctgcgggagaacctgcattgatctgatcggtctggccggccaggtggaaaacatggtccaggaatatgagctggatatcaaggtggccgtgatgggctgtgtcgtaaacggcccgggagaggcaagggaggcggatcttggcattgcaggcggcatcggggaaggactgctgatccgcaaaggtgaaatcatcaaaaaagtgccagagaaagaccttctgcccgcactgaaagaagagcttgacaggctggccggaaaactggaataatagagctgcagggtgaaaaagaaattaaggtgatggaatgaaatcgtttttggaagtatttcctgatttacatattgcagataatgtgagagagctttttgagctggtagaggtggagaaggtggccactaccagggatagaagctctatccgcatttatatcgtcagtcccagactgattcataaacagaacatctataagctggaggaggggattaagagccagctcttccccggaaaaaaggtgacgattaaaatcctggagaaatatcatctctccggccagtacacgccgaaaaagctgatggatgtttaccgtgacagcatcctgatggagcttaagaattacagcattcttttatacaatatgttccgcagggccgttctctcttttgacgagaaggatcttctgaccatggagatcgaggatacgatgatagcaaaggacaaggcgccggagcttgtgaggatcctcgaaaagatctttacggaacgctgtaacattccgatggaggtcaggctgtcctaccgcccggcagaggccagaaaaagggtggaggaggagcctgccgtcatctatatgaacgcggagcatacatccggcggcgcagcgccgtctgatccggctccggtctccggggaggcctccctggatcttccctttgacgagggcagctcggtcttaaagccggtgggcgatttgaatttccaggcggagaagaaacagaaagcagttaaggaaaccggcggaaagaacgcccagtcaaaagcgggaggcgatttaagcggcaaaaagggcaaaggcgattttagcggcggaaagagggaattccggcgctccggctacggcagaaagtcggataatccggatgtcctgtatggccgcgattttgacgaagagtcggttgagattgagaagatagaaggggagataggtgaggtggtgatccgcggaaagatactcgccacggatgtgcgtgagcttcgcagcggtaattccctctttattttcagtatcagtgactttaccgatacgatcagtgtcaaagtgttcgcccgcgaggagtcacttgaggatttgaagactgcgacaaaggccggccagtttgtcaggctgaaaggcgtggcgaacatcgaccgtttcgacggggagctgaccatcggttctgttgtgggtattaaaaaatgcgaggattttacgacgaaacgcgtggacaatgctccggtcaagcgtgtggaactgcactgccataccaagatgagcgatatggacggcgtttccgaggtaaaggacctcattaagcgggccaaacagtggggaatggacgcgatggcggtaacggatcacggctgtgtccagtcctttccggatgccaaccattccgtggagagaggtgataatttcaaggttctttacggtgtggagggatatctggtcgacgatatgaaggaactggttgaaaacggtgcgggacaatccctggatcatacctgtgtggtcttcgatatcgagacgaccggcttcagccctcttaagaaccggatcattgagataggcgcagtcagggtggaggagggacggattgttgataaattcagcagcttcgtcaaccccgacgtgccgattccctttgagatagagaagctgacgggtatcaatgacaacatggttctggatgcgccgaagatagacagggttcttcctgaatttctggagttttgcaggggagccgtcatggtggctcataatgccggttttgacatcagctttattaaagagaatgcaagacagcagggacttgagtttaatccgaccgtgctcgacacggtatccctggcccgcgttctccttccgaacctcaaccggtttaagctggatacggtagcaaaagagcttaagattaacctggcaaaccatcacagggcggtggacgatgcaggggcgacagcggaaatctttgtccgttttataaaaatgctgaaggaacgtgacatttttgatctgtcccagttaaatgaactcagcaggatgacggtggaaatgatacggaagatgcccacctaccatattatcataattgcgaaaaacgatgtggggcgcgtcaatctctaccgcctcgtatcagagtccaacctgacttattttgccagacgtcccaggatcccgaagagcctgcttagccagtaccgggagggccttatcatcggttccgcctgcgaggcgggggaactctaccaggcgcttttacgcggtgtgcctgatacggagatacataagatagtggatttttatgactatctggaaatacagcctctgggcaacaatgcatttatgctcagggatgagaaaagtccggtgaattccgaggaagagctgatggatttgaaccgcaggattgtgggtctgggagaacagtataataagccggtctgcgcgacctgtgacgtccatttcctggatccggaggatgaggtttaccggagaatcatcatgtcgagtaaaggattcaaggacgccgacgatcaggctccgctctatctgcggaccacggatgagatgctcagggaatttgagtatctggggagcgacaaagccgaggaggtggtaatcaccaataccaggaagatagcagccatgtgcgaaaggatagagcctgtccgtcccgataaatgcgctcctgttattcccaactcggatgagacgctgagaagcatctgttataacaaagcccatgaaatgtatggtgagaaccttcctaaaattgtggtggatcgtctggaacgggagcttaactcgataatttccaacggtttcgccgttatgtatattatcgcccagaaactggtatggaaatcaaatgaggacggctatctggtaggttccaggggatccgtaggctcctcgctggtggccacaatgtcgggtatcacggaagtaaacccgctcagccctcattattactgcaccaattgtcattattatgattttgattccgaggaggtcaggaaatttgcaggtatggctggttgtgacatgccggataaaaattgcccggtctgcggggaaccgcttaaaaaggacggcttcgatattccatttgaaaccttcctcggctttaagggtgacaaggagcctgatatcgacctgaatttctcgggagagtaccagagccgcgcgcatacctatacggaagttattttcggaaaagggcagaccttccgtgccggaacaatcggcacactggccgataagacggcttacggctatgtgaagggctattacgaggacaggggcgttcgcaaacgccgctgtgagatagaccggattgtgggaggctgcgtcggtgtgagaagaacgacgggacagcacccgggaggcattatcgtgcttccccatggggaggaaatctattcctttaccccggtccagcatccggccgatgatatgacgaccagaaccgtaacgacacattttgattatcactccattgatcataacctgctgaagctggatatacttggacacgatgatccgacgatgataagaatgctccaggatctgacaggccaggatccggtaaaggattttccgcttgacagcaaagaggtcatgagcttatttcagaacacctcggcactgggcatagagccggaggatatcggcggctgcaagctgggcgctcttggaataccggagtttggaaccgattttgccatgcagatgttaattgacgcccagccgaaatatttttcggatctggtgcgtatttccggattgtcccatggtaccgacgtgtggctgggaaatgcccagacattaatccaggagggaaaagcaacaattcagacggccatctgtacccgagacgatatcatggtatatctgatcggcatgggcctggaagagggcctggcgttcactatcatggagagcgtgcgtaagggaaagggcctgaaggacgaatggattaaagagatgaccgatcacggcgtacccgactggtatatctggtcctgtaagaagatcaagtacatgttcccgaaagctcatgctgcggcttatgttatgatggcctggcgtattgcctactgtaaggtgttttatcctcttgcctactatgcggcgtttttcagtatccgtgccagcggcttttcctatgtactcatgtgccagggccgtgaaaagctggaatatcatctggccgactataagaaaagaatggatacactctcgaagaaagagcaggatacgctccgcgacatgagaattgtccaggagatgtatgccagagggtttgaattcacggccattgacatctttaaagccagcgccaggagtttccagatagtggatggaaaattgatgccgtccctcagcagtatcgacggactgggcgagaaagcggccgacgctatcgtatttgcggcggaggacggaccgttcctgtcaagagaggatttcatcaaccgcacgaaggttacgaagaccgtgtgcgatctgatgggagaactggggcttttgggggatttgccggagagtaaccagctttcgttgtttgatatggtgatgtgatgataccagggtcaaaaggttggaaatctgatgcaagcttgcttgcatgaagatttttaatcttttgaccctggtatcatgtcatttagttaagcaggtgaggtcgctgccgtacggacagcggtggggatgattggatgagtcttttgtcccgggggaggattgtcgtgagttggagctgcggagaagattttcaccgggacgaaagcctccgagcctcaattaaatctcaattaattcatattccatagtaccaatcccaagcttttccgcatgttccagcgccactttccagttggtttccggatggatgtccgtaaaatgatcatggtggcagtgctcacgctcatcgagtatacagcctgggattgcaggctgacggtttacggcatcggcacaggccatatcgagggcaaccgggtcaaaggaagcaaacattcctacattcgggatgatagctgcgtcattttcagcatggcagtcacagtagggggagacatccacgacgagactgatgtgaaaatgcggcctgtcctttaaaacggcgagggaatattcggctatttttttatttaagatgtcatttgattcatcacaatggtttgcaacggcatctaccggacagactccgatgcagcgtccgcagccggcgcatttatccggtgcgatggaggcctttttctctgcgatggaaattgcgtcgtgtgcacagttgcgcttgcaggctccgcagccgatgcatttatcggtaaggacaaaggggctggtggcgttgtgcatctccagttttccggcgcgggaaccgcagcccataccgatattttttagcgcacctccgaaaccggtggactcgtgacctttaaaatggcttaaggagataaagatatcggcatccataatggcgcggccgatttttgcctctttcacgtactccccgtcaatcgggacgaggatgtcgtcggtacccttcagtccatcggcaatcagcagatggcagccggtggtaaagggattgtagccgtttgtgtaagcggagtcgagatgatccagggcattcttgcgtccgcccacatagagggtattacagtcggtgaggaatacctttccgccctgttccttaatcaggtcgacgataactttggaataattcgggcgaagataggccaggttgccgggttcaccaaaatgaattttgatcgcggtatactggttcttaaaatcgatttgctccagcatccccgctttctttacaagacgggccagtttctgaagaagattttcagtaaatgttgccctgaagttagtaaaatatacttttgaagcagacataggatacctcctgatatgtattgattaacgatgaaattatagcataaataagaatggattgctactgttaccgtttatagcaccatgctgccgaaatatccaccatttttattgtacactcgggaattttatggtagactagagactaatttgaacagtattatatattatatgaatgacagaggaggacacaccaatgagccagaaacgttcaattgaaaccacctgtattcagggcggctggcagccgaagaacggcgagccgaggatacttcctatttaccagagtactacatttaaatattctaccagtgaacagatgggaaggcttttcgatttggaggagaacggttatttttacaccaggcttgccaatccgaccaacgatgccgtagccaataagatttgtgagatggaaggcggagcggcggccatgctgacctcatccggacaggcggcaaatttttatgcggtgtttaatatctgtaatgcaggcgatcattttatctgttcttcgaccgtatatggcggaacatccaatctgttcgtcgtgacaatgaaaaagatgggaattgaagtaaccctggtggatccggacgctccggcagaggagatcgagaaggaattccgcccgaataccaagtgcgtgttcggcgagtcgcttgccaatccggccatggttgtactggattttgagaaatttgctgccctggcccataagcatggggtgccgttcatcgtggacaatacctttgccactccgattaactgccggccctttgaatggggagcagacattgtaactcattccactacaaaatatatggatggccatgcgatgagcgtaggcggctgtatcgtggacagcggcaattttgactgggaggccaatgcggagaagttcccggggcttacgacaccggatgattcttaccacggaattatctatacacagaagttcggaaagggagcttacatcacgaaagctacggcacaggtaatgagggatctcggttccatccaggcgccgcagaacgcattccttttaaatatcgggcttgaaacgctgcatctgcgcatgccgcgtcactgtgagaatgcacagaaggtggctgagttcctgaaatcctgcgaggaagtggattgggtaacatatccgggccttgaggatgataaatatcatgagctggcaatgaaatatatgccgaacggcacctgcggagttattgcattcggcttaaaagggggccgtgaggcagccgcggaatttatggataaattaaagatggcggcaattgtaactcatgtggctgatgcccgcacctgcgtgcttcatccggccagccatacccaccgtcagctctccaatgaacagctcctggaagcgggcgtcgatccgtccttaatcaggctgagcgtcggtatagagaatgtgcaggatatcattgaggatatcaggcaggctctgaaataaatatattgaccggcagatagtttacatatggaaattttctaatgaataaaagaggctttttccggaaagattcaacttttggttgatctttctaagggagaagcctcttttattatttatattctatgataccagggtcaaaagaccttttggccccaacatcattctattttggtaaaatccggcaggcttcggtaatgtgaatttaggagcgttaattctctgctataatattttatgataaaatccggtgcatacagttttgagagcaggccggaaatgatacgaaagagggacttgggatgagggagtgtgtcaaaaagctacgggaagaatggaaaataaagctggcatgggtgatgatttgtacgattcttctccaggctttggcaggatggagagtgattcctgttatggccggtgagacggagaaaatggatttatcaggctatgcgacgccgtcggatgcgtttcagcatttcaatatgtggacggacagggacacggtgtccggaaatgggtttgagctacaattagaactggcatttgataataattttttggaaacagcggttgaagatgcccaaggcgatatcgaaaagtgtccggacctctcttttcagataaaagtggaatgcagcggcttaaataaaaatattaattttcagaatcaggagctgacttatggggatgccttaatcggaaccatggttacggagcagaatggaacgtgtatcgatatatcgattatctttaacaaagaagacatttacagcggttatcagaatattgagtcaggtgcacaattatccctcggccttgaagcaggccataatggagatgagatagaactggaagacaatcaggagggaattgtcaccgtcaaattgtcgtcgcaaggttccgggcagccggaggataagggagcctattcactggttaaaaaagcggatagcggagacggtttggatatcacctatacaattacagccagggcctcctcctctgaggcgtccctggcccaaaaagctacgccggcgacggcatcttcaggctttgaagatatagatgactgggagacctggcaggccatggatgaggacgaggaagacgaagagtatcaagaggaggacggggacggaacaacaggcagtgcaagtcagctgaagaagaggaagtcctcccggagaaaaatggcagaatcgtcaaaaacctatacattgggcgggaagcacatcatcgatgacgtgccgtccgaattggtggtgacacacgcctatgcagggacaggagatgcgaaggaagaacttctcccgctggaagactattatgatcaggaaaatggcaggttcgtttacccgattgcagccagcgcctcagaagcggacgccgggattataacagacagcgccggaaatatcatagaggcatcggttacaattgagacagaaatcagcagcagacttttagaaaactggaatgaacaaaaaaatctggagctgacaattcaaaataaagcaactctgagggatggtgaagatagccagaccagtcttgccgaagcagacacaacaacgaaaaaaacgctgggacaggagctgacaaaagacggacaggagatattaagccaaggggagaataaaatccgctggaaaatcaaaatgaaaaccctgcttcatacccttcactcggcctatctgattgactggctcggggaaggtcttgaatatgcggatgagattacggtaaaggagggaggggcggaaaggacaatctctttcaaagcttccgactccggcattcaactggaattggggaaacagcctccaaataattattttaagaaaggcggttttctgtccgggatagaggaagagcttaaggacttcaaagaaggggaggcggtgcgttttagttattcctatcagtcaccggatggtaaaatccataacgcacagggatttatcctgcccgctctcgacctggttaacaaggatgtagagcttgtttattactcaaaggttccaaagacttctgtgacggaagggcagggaaccgttacaaataatgcaacacttttccacaaccatgttacgggagaaggaataggaccgtgggactggcctccggagaatattgatctggagcatagggttgactataaccataatgccctgaaaaagacggccggcagctacgacgaaacaactcagactatgacatggaaatttgaaatcaaccgttccgccgcagaaatcagcagctttacgatgagagacgcctttgatccaccgaaacaggtgattctggacagcaatttcccggacggaaagttagttcttaaaaaagtgaaccgtgataatccggacagcggagacgatgaggtgaaattaatggaaggaggccattcgggcgattactatacactcgaagagactgaggacggaatcaggcttctgaccatacatctggctcagatagaggcgcaggagtattattcttttgaaataaggacgcgcattgttgatccggtgagcctcagccaggatcagggcagggtagagaatactgcagaatatgagctgacctccggttcggaaactattgaaggcaccgcggcagacagcagattaataccgaacgcatacgtcagtaaaaaagcaatagacagttataattacagggataatctggtgaaatggcagattggctataaccagaacaatatcctgctgaataattccgttcttacggaccatctgccggtaggaactgtgttttcaacagatccggccttaaaaagcgggctgaccggcgtctggaaaaagacgcggcaagacagcagcgcggggacatacagggaggtaagctttgaaaaagctgcgtccggttcggagcttcggcgtcccgcttcccctgcaaatctgacggaagcggaagaaattcttcgctataagctggacggcacggatgatacgatacttgccgtatattcggtgacagaaagaacggcgcaggagaagtatgctgatcaggacattttctttgtcctgtatgaaaaggctgaggacggattttatgtccctcttatcggcgaagatgcctggcagtatgaatttacggcctatgtggaggagaagtacaggcaggagaaattcaaaactgcagaggggctgaagctgctgaatcaggcggcactggacagcgatattatctccactagggagaatgaaggaatgccggtgcatatcacaaaagatgcgcaggcgtcgcataccgcagcggtgcatatgctgaaaaagggggagttccatccatttaataaagaagatacgtatgaccgccttccatggcttaaatgggaattagccgtgaatataacgggagtcaattttgaaggagttaaaatttccgatcacatggccggctatctggagcttgaaccggcgagcatgagattttacaggataacaatggctcccgacggcagctatgattatagccctgattcaggtctgactgacacggaaattgatgagaattttacggtggtaaaaaacggcggaggctttacaatcgaatataaggagtctgcgcccctggccagggtaccggttttagtagtttacgacactgttgtagtggattctgttccggacagcggagccgacaatacggtcctgattgaatggcccgacggcagcagcgacagcaccgttaccacgaatgcagaggccggccggttccagagcagctcatttgcaaaattggaaaagctgcagatggcgacagtgacaaaaaaaagcgctaattcatcagacagcggcgacggctatactctacagggtgcaaaattccagttaatccctgttttcaagctgcagggcgagtcaccgtccaatcccggagcgtgggtgcagatgaacgatccgacggcggcaaaggtcagaacatcgaatgaaaacgggcagatgtttttcctccgcctgcaaagcaacacgatttataagctggaggagacccaggcagcgccggggtacgatagtctatcctttaagcctcagcatattctgtttgggaaaggggcgcttgacagcctgccaaagcttccggacggtgtggaagatactctgcaatatcaggatacagtctcaaatggggcgaaaatgtattttgacgcattaaattcccctcaggatttggaaagcaaccggttccggttctataagacggataaagacggcaacggtctgaagggcgcggtgttcacgctcacggcgattcaaagcagtattctgactaacagggattcggtgagtgatgagaacggcaaggtggactttgccggactggagcctggcattatttacagtataactgagaaaaagccgccatacggttataaaaaggcggccggttccctcactttggaggcagagtttgacagcgtcacgggagaatttgaaataaatgcgaatgcagtcaatggttttccctatattccgggagacgatgccgccggtacagaagcttcggtgataaatgagcctattttatccaacattgcattttataaaacaggccaggactttgtaccgcttaacgggaatacatatccagtcagatttaaggtcgagagaaaagcggccggagaaccggaggaaagctttgaagactggagtgcagggccggatgggagcagcatgataccgctgacagaggatgggcttgtgaggctcgacagcctgccctgcggcgtttaccggtttacggaggatgtctccgaagtaccggaagggctccttgcaccggaacaaaagatgcaaaagattctggtggagattgagcctgcctcagatggtttaaacggcagcgtcacattttataattgcagtgacagcagtatggatgagacaatgattaaggctgaaggtgtattaaagaacggctgttttcagcctgccgacacaaaaatccttcaggtaaccaacagcctgcgtttcggctatattcaggttaacaaggtaaaagcagtcaggatggacgataagctgactatgacaagcgagccggctgcaggggcagggttcagtgtatacgaggcaaaagtcggtacagaagcgatatgggagccggtggataaggatgtgcctcttctcaccctgacaacggacggtgaaggtcatttcagccgggaagagatgggagattccctcatagcaggcaggacgtatctgatcagggaaagcaaagtaccttccggatactgcaaagatacaacgctcaattaccccggatatgaggggccggaaaataaagggtttgttcccgtgacgatcggaagagccggggagacatactatatcggtgcagtcaataagggaacttccgatgcataccgggcagacaaaacttatgattacggagctgccggcctggcatcaggcagcgatgagaagctgctgtactataatatcgaggcacagacaggtaatgttaaaggggagaagcttggagcattttattatgacggcgccgggatcaccagaacgcctctggaaggcgtaacattcgaactcacagagcttccggttacggagtattcctacagggcatccgccgtgacggatcagaacggctccttcctgtttgagaatattccggccggctcagccggagaaggtaaagaatatgaactgagggagattacacccgctttcggctatgagactccggacgacacggacaagtttgtcagaacggtggctgttaaggagtatcagacggcggagatcgacgtgacaggggaaccccttgtgtttttaaatgatccgcttacctttgaaccgaaggtgaataaaaaagatccggagctggcgccgctttccggagcagagttcctgctggaggcggaggcggaggatggaacggtcacggaaatctgttatttaaaagaaacagcgggaggggtacactccattccggatcccagtaaggaatccgatcaaaaatacatgaagcttagcggttcggacatttggaagtattttacatacacaggcgcaaacggcatgggtgcattgaccgccggtacggagacaccaaagctttattacagcggcagctttgaataccggattcgtgaaatcaaggccccggccggatacatggcggacggtgcgctttacaaagtcgaccgctcagcggccgtcaattcggcagacggagtctgttatatttccaactcccaggacgggaagagctttgttaaccggtaccatgaagatatacttttgcttgagaagagaatcgaagcggaggatggcggtatcgttgccggctcttcgggtgcggatgtctccggcttttgtttccttctgacaggaaaggactttaatggaaggccggtggaggaatggttaaaagtggaagatatcaccggagcttcggaggtgaaaatcgttccctccgaaggcatctatctggaaacggaaaaagacggagaaattgttatccgttccatcaaagaagggctctatcaggcaaaggagattgagggaagccggacaggcaaaagcggagcctatattgccgacgccggaccacagacagtgacggtccgaaggcagaaaggcagggtaaccggcggtaagttcctttttattaattatctgaagcgcgggactataaccggaaaaaaggttgctgccccggtgacagatacttctgcaggtctctcaggcgccctgatggggttatttaaagagggaacagggaacttcacaatcgataacacatacctgggaaatacggcgttaagcggcagcggcggtgagttccgttttgaagatattccatacggaacctatattgtggcggagattacacctccctccggctattatctgaaccgtacggtatcctaccgtgtcgtcttatcgggagcttcggagagcgaagggactgagctgattaaaaacagttcggacggcgccgtcaccgccgcagaggatgagagcgagattgtcatcggggactggaggatagagagcgcaggtcatggaggcggcagcaggccggggagcggtggaaacagccgtccgaccgggccgggattagtggagacacagccggaaatacagaaggaaccaggtattttggacgaagaggcggcggagcctccaaaggagatgcctccgtctgtcatttggccggaggattcggagaattttccgcctgcaacaataaaaagggaaccggacggtatcatccgtgttgaaatacctgacgaacggatcacttatgtaacggtgaaaaatgacagagatgaacttgtctttgagggcggttatgacaaaggtttcacgattacttcagagctgcctgcaggagaataccggcttattacaatggatgagaacggggtgccgcttggcagctatctgttcgtaatagacgagggcggcgtgccgctggcgtctctgcccaggatgggagagcattccctgccggtttcggcgctgcccgtgattatggccgcctgcattctgctgattggttatttcaggagaagacgcggatagcccgacagagtttaaaactgcggatagaaacgaaagtccgggcgtgtagtcggcttttgcgtgtttctgctttccaagttccataccagttgctataatagagaggtacaaagatgatgaattatagcagaggtggaagcaagtgatacagatagcagtctgcgatgatgaaaaatattacagggataagatacgggaactggcggctcagtttctggaaaaaaggcagctcccatataccgtcacggtctatccgtcgggggaagattttcttgccggggaggaaaatctcgtaaaatatgatattgtttttctggatatcagcatgaaggacatagacgggatagagacagcaatgcggatccgttcctttcactccggaacctgtattgtgtttgtgaccgcatttctggattatgcgctggatgggtataaggccgacgcagtgcgctatctgatgaaggattccctcgggacggagatggaggaatgtatggctgcagttctggaaagaatggagctgcggcaggtggcatttccgtttaccggaggggtacaggaactatacacggataatattctttacgtggagagcaggaaacataaatctgttttcttctgcctggagtcagaacggaaggaataccagctctatgagaagatggatgtgatcgaagagaagcttggtcagtatgcttttctccgcatccataaaagctatctcgtcaatatgaagcatataagaaaaatcagcagttatgcggtaatccttgatacgggggagagcctccccgtgccccgccttaaattccgggctgtcagggaggcgtttaccgcttacaaaggagcatggtgatggagatacttatcaggggaaccgtattgccactgattcttgccatgagctgccgtatattttatgatacgattgccgacggcagggaatggaggcacagtctgacgggagggacagtccttcccgcctttctgctggcttttttctttattgcctttactgaaataccgccgtacctgttccagccggtccggatgattgcggccgttttcatcgtggcgcagatttattaccggatccgtccgcttcagaacctgttactgtcaacgcttttctgcgccctgatctggataattcagatgtttgcttctttgcttatttatattttatacggccgtggagggaaccgtctatgggggatggatgaaatcctgtgctatgggctcctgctgtgcctgatgctgctgtttcagaaagtctataaggggagagacggcattcgcgcgatggccggagaaagctggggcagttttatctgttttcctgttttcagcattattgtgtctgtggctctgagtatgctcaccctggacggagacagggaggacgggaatatcatgttgattgtgactgccggattctggcttatcaatcttgtggcttttgatatgatggaaaatatcctggcaggacgggcaaaggcggagaaaatgcggctgtcagccgagaggaacaggaaccagatggagatttaccggagcttgcagcagggggatgagtgcaggaaaagacagatccatgattacaaaaaccagttaaactgcatccggggcctggtggatgacaacaggacaaaggaggcgctgcgctatatcggccagcttaccggcagcctgaacgaaagcattcatcagattaatacaggccatccggtggtaaatgtgctgctgaaccagaaataccaatcagccagggagcagcagatttcgatgacaatgacgatgaacaatttgtcggagctgtccctgagcgaggaagatattgtgacgctgcttgccaacctgctggacaatgccatcgaggcctgtctgaagcttcatggagacaggagaatacaattgaagatggttctggaagaggaggagcttttcctttcgatccgcaatcccgtggagtgggaggtgaaaatcagcggcaagacagcagcggcggcaaaggagaaatcaggggagcatgggctgggccttggcaatgtggatgccgtgatacgaaaaaacagaggcagaagcacactgcaatgccaggagggctggttttgttttaccgctgtcattttgcagccgcagcgctgaagccgggcaggagccaaagatgcaggcttctgcttttttttgctgtccggccgccgatttgtgccgcctgtattgatgaaacgcgttctgaccaatacaatgagggaagaggaatacaggagctggtcaatcagccacggacaggaggatattatgaaacaaaaagcaaggcattttacggccgcttgtttgataatcagtattgcggtatcggcagccgcctgcggacagagcgggaccgctaaatcagaacaggttacggaggccggcgtatttaccgctgagacgctgtatcctgaaatgattctgacaaaggaggagatgctttccgactatgacgccatgtggaaagccgtgaaggagaactatccctttttcggagtgctttcccgcaacaatccggagcatcctgattattatgacgaagtcatcggggattaccgcagacagattatcaatatgcagcaggaaggcgatgcggcgatgtgggaatttataaccattgtgtccggcagtctctatgatgtgtgcggtctgaccggacacgcaggcatcctgaacccccattatttccgggagcttgatgtcaacaaaaaatatatcagggagtatccggagctccagccctgggttgatgtatccaaccgtccggaggttatatcattttatgattactacgattatctgctgacatttttgaccggagcaggagaggaaatggagggagaagacgaggataaggagcataacggtgttccggcattgggactgcatatggaacggctgggggataagggagatacggcctatgtcagagcagattcttttgacgattcacggatggaggaggaagtgcctgagatacgggatttcctggaggcggcggaagactgcggaaatctgattatagacatacgcggcaacggaggcggaaataccgtttattgggaagaggcatttgtacggccaaatctgacggagccgctaacgtaccggctggtaaggctgatgagggatactgctttagccggacagttttacggctctttctaccagggctcgaacctcagtgcagaggaggttaaaaacgatcccaggtattctgaatttcctgaggaggataaaagagggctggcgctggcaagggaaattgtgacaaccattgaaccggaagacagcggcagcgtgttccggggacggatatggctgcttacgggaccgtccgtatactcatcctccgaggcatttgccgtattctgcagggagaccggctttgccacccttgtgggacagagaaccggcggttccaacagcgggggcgcaatcctttatgagcttcccgccagtcaccttctgatccagtttgacgtggagtactgcctgaatggggatggaagctgtaatatggagatgggtacggctcccgatatcgaatcggacgagccgctgcagacagtgcttgacataatagcggacaaatcatgaccacccgtcaaacgggtggtttgctcgcccctataaggggacagttaccggccagcgcctaaagacgctggctttcactctgttcaagccactatgcccttgactcgtcgcccccccccctttaaagggcgtttgtaataccggctaccccttaaaggggtcctcatattcctttacactcagtttatccattgctatatcatacttctcctgttcctgaatgtacttcctaactgttgcctcatttagacctactgtactgacataataaccttctgcccagaagtgacgatttccgtatttatactttagatttgcgtgcttatcaaatatcatcagcgcactttttccctttaagtatcccataaagctggatatactgtatttcggtggaatacttaccagcatatgaatatgatctggcattaagtgaccctccagtatttccactcccttatatccgcataacgtttttaatatatctcgtatgctttctttatattgattataaatcatttttcgtctatacttaggagtgaacacaatgtggtatttgcacatccactttgtatgtgccatatcatgtttcttgtgtgccattaaaatcacctttcctttcttagatagtagcttgaacaactctattctatcggaaaggtgatttttgtgctataagcacttgctgcaccacccgcaaagcaggtggtttcctgtttcaggcattatcatttttcggaacacgaaaaactccaatgccttcaactggctaaagccagaacgataatctgaacgctccgcgtacaggtcacagcagcaaaagcggtagagtaaaaatactctatcgctttttatataatggtgatataatcttgattatggttttaccatagctttgtcaagtcaaataaaggatgtgaaagataccgatgaaaaaattaagaggattgttaaggattattttcggccggaccacgtttgttgtattattcctgctggttcagatgggagtgctgctggcgggctttaactggctgagggaatatatgatttatgtgtacggcggttcctccctgctgagcgctgtagtgcttatctacattatcagcaatgacgagaacagcagtattaagctgtcgtgggtggtgccgattctggtgattcccgtattcggaacactgttctatctgtttttaaagcttcagccgggcgtaaagctgattaacagaagaatccagtctctggaaaaggggattgccccctatctggtccagaatgaggaagtgctgcgggaatataacaatatcagttccagcgaaggcaatctggcccgatatatgaaccgatacggcgggttcccggtttaccagaacacgaatgtggagtattttcctctgggggatgatatgttcccgaaaatgctggaggaattaagacaggccaagcatttcattttcatggaatattttattgtggaacgcggaattatgtggaatgcaatactggaagtcctcgagcagaaagcaaaagaggggctggaggtccgatttatgtatgacggtatgtgctctctggcgctgcttccctattcctaccctaaaacgcttcaggcaaaggggattaagtgtaaaatgttttctccggtgaaaccggctctttccagctatcagaacaacagggatcatagaaagatatgcgttatcgacggccataccgcatttaccggaggggtgaacctggccgacgaatatatcaacaaaagggagaggttcggtcactggaaggatacggccgtgatgctgaaaggcgatgccgtaaacagctttaccatgatgtttctccagctttggggagtaacggagctggaaaaagaggattacagccgttttcttctcccggcggattacaggtatccggaaggaatggattacagcggttttgttatgccttatgcggacagtcctctggacggagagaatgtgggcgagcaggtatacctcgatatcctcggccatgcaaagcggtatgtgcatatcatgaccccatacctgattttggacgacgtgacgctgactgcacttaaatattcggcaaaacggggagttgagacgattattatcatgcctcatattcccgataaactctatgcctatcttctggcaagatcctattatgcggagctgctgcgtgccggtgtgcagatttatgaatatacgcccggctttgtccatgccaaaatgttcataagcgacgacgaaaaggccgtggttgggacaatcaacctggattacaggagtttgtacctgcatttcgaatgcgccgcctatctctataaaaataataccgtatatacagtggaggaagattttcaggaaacgcttggaaaatgtcggttaatcacactggatgactgccggcggtattcaccggtcaaacgttttgcaggaaaagcgctgcgcctgtttgcgccgctgatgtaaaagtgaaaaagtactgaataggccgccggggcggccggactgtgagacagccggctgccccggcggttttttgcaggagcctgtgcgtgctgcgtgccatttcttacttttttcgaaaaacatcattaatatatcgaaaaacgataaaaaaatattgattttcggttttttgcatgttatactgcccataacagcataggtccaggaacatgctgaatttactccggaggtgtatcatatttatgaactggaataatgaaaagtcgatcgggttaacaaaattctttattattttatttgcggcggtttacatactggtgctggtgttctgtccgagaatgacaagggagttcgtggaccacagtttttctgcccgcggtaaagattttaacctatttatggtaaccatctattcgagtgcggttcctctcggcatcattttatggaatctgtacaggatgataggcagaatcggtgaggaacagattttcagcgacgagaatgtaagctgtctgagactgataagctggatgtgttttgcggttgccgtcatctgcctgatttctacggcttattatgtttttttcctgattatagcagcctgcgcggcttttatgggacttctgatccgggttatcaagaatgtattcgtaagggctggggaaatcaaagaagagaatgattatacaatttagagggaaggggctgtcatgggaattattgtcaatctggatgtgatgatggcaaagaggaagatttccgccggagatctggcggagcgcgtcgggatcactccggcgaatttgtcgatactgaagaataataaagcaaaggccatccggttttccacgctggaagcaatctgccgggagctttcctgccagccgggcgacattttggaatttgaggaggagcagctatgatgatggatgaaaatcaaaggacagtggaagagtaccaggtagaagagcaccggacaaaagagataagtgcagaaagccggagggttaaaaggaattatgaaaggcgtgactatcttctcgctctgatcatggccgcagcgtcatttgtctatgtccggggcagtgagtttttttcaggcgcctggctccccctgtttacggcactgttcgtttctgccggagttttttacctccattcccttggacgcaggatggacagagaggggaaaatcagtctgttttttctgattgcgggagctgtctggtttcttgttaaatatctgcctggccggcaggaatgggagcttcaggggataatgccctatgtgactttattcctgcatggagcaggagtctactggctcctgaccgtcagcggggcaagaataaagggagtgttggatgaaagctgtattttggatctgggaaaaggattttttgccctgccgtttatgaactttggtgaagtttttctggcagcggcgcatggggtaaaacaattcagaagcagcgatcaggagacaaagaaaaagcagaaggataaagcaggacagattctgttcggagtcatgatgagtattcccgtactggtgattgtccttcccatgcttgcaggggcggatgagagcttttcggcttttgtgggcggactttcaaatttgtgcagcaccctgacagagaatttttttgaagcgcttttatttggcaatttattgttgaatctgatggtaattctcggtacctgttatttttatggccttttttacggagcttttcatgcaaaatccacaaaagaagacgcagggcaagtaaacggcagccggtctgtcggtctgccctatgcggttatgatgtctttttcatcggcggtctgcggagtttatgtactgttttttctggtgaagttttcagacattcttgcgaaagctttttctcaccagcagagctttgtttacagtgattatgcaagacagggcttttttgaactctgttttatttccgtcattaactttggcctgttctactttatcaaggtattcagcgatagggagaaaaaaacagtaaaacttatgctttccctattgtgtgcggagactctcggatttattatgcttgctttttccaaaatgtgcctttatattagtgtatatggatttacctttaaaagggtatttaccagttggtttatggcagtgctgttcatcacgtttttcaggctgttctattgcatctggaaacagggcaatgccataaaaacagcagtattatttgcctctgccacatttcttctgctggcatacagcaatatggagggatggatgcgccaggcaaacctgatgatgggctttttgcagcagtagcatggctttgcgggggcctgtccgggaagaaaggagatacgattcaaaattgacagaaggagcacttgtactggaaggcggctccctgcgcagcgtatttacggcaggcgtgctggatacactgctggagcatgaaatcaggctttcctatgtaaacggagtttccgccggtacgatggcgggaatgaattacatcagcggacagaaggggcgcatgctccgcattaataaagaatatctgcatgacaggcggtatatgggactgaggagcctggtgaaaagcaggctgatattcaatttcgactttgtattcggagaattgagcaatgaactgattccctttgattatgacgccttttacggttcccctcagaaatttgaggtggtagccacgagatgcaggacgggaaggccggaattttttgacaaatcctcctgcacggagatgatgcaggcagtcagggcctccagcagcattccgatgctttcacggatggtgaaagttaaccataaaaattatctggacggaggcgtttctctgccaattgcttatgagagagcttttgaactcgggtatggaaaagtggtggtagttctgacacgccatagaggttacagaaagaagccggtcggctccatgacggagagggcctatgagcgctattttgcgccgctccctcatctgcgggaagcgctttatgaagttcccggacgctataacagaatgcaggaagaaatagacaggctggaggaggaaggacgtatctttgtaatccgtcccgagtatccggtggacgtgtcacggttcgagcaggatgtcagaaagctggagaagctctaccgggaaggagtcagaatcatggaaggacggctggaagcattggaggcgtatttagaacaggaacaaaagtaaaatatcgtgttaaattttcaaggaaatccgatcatggattcatctataagggctagatctctcgaacagggaggtttggcccttttattgattgcgttgacctgtgcgcggagcgtgcagttatcattgaagatggtgaccatgaaatctaccatattttcacagtttgaacacaaaatgcacacaatttattgatatagtttcaacaaataaacaaataagatgaatatacggttaaatgaaaggcggtaggaaaattatatgaacagacagcgcacagcggttaccatggcagccataatggcattttcagcggcggctccgatgacggcggaggcatcttccagctacagtatgagaaagaaagtaattactgcggccggcattatgacggctgagtcagacgacagcaggcttgtgacgagggcccagtttgccgaaatgctggtaaaggcatccacctaccgcagcagtgtcagctctgaaaataacgtttccattttctccgatgtggacagaaacagtgaatatgcatcttacataagagtagcagttgagcagggctggatgacgggatatctgggcgggaaattcaaaccggatgaaaatattacgatgcaggaggcggtaaaagcagttctggcccttcttggatatacaaatgaagattttggaagcaaccaggcggcaaacaggctggctaaggcatcctatctggaactggacgaggagattgggaaaaccggagctgaagtcctcagccgctttgattgtgtgaatctcttttataaccttatgaagaccaatacaaaggagaatgaaggaaaggcagaaacaagttccacggtctatgcggccgtactcgacttcacacttacctcggatggggaaatcaatccgctggaagcgctggaaagcaagctgaaggggccgatagcggttaaagacaggagcttgaaaagtatcctgccattctccctatccaaagcatccttttatctggacggtgagtcggcttccgcggatgagctggaggacggggcggtcgtgatttattataatacaacttcgagggctgtttacggctattcggagagcggcaacggagggcgcggagcgacaaaaggcacgctcgatgcaatctactataaatcttctgatgtcatgataccgacttcgattgttgtggatggagtggaatatgaactggccacctccgatatgcagttcgctttctctgtttacggtgatttaaaggtcggcgatgagattattgttatctgggaaaacaagacggcctccgccgtggatgatgataacgacaatccggagtataagctgattgattatattgaataggcggggagaatagaaatatgaaagaaaaagttaaaggtctgtttaaaaggctgcgtcaggcaagggggccaaaaaagccgcgcaaaatgagcagaaagaagaagctgcttaccgcagcagcaggactcattttgttcctggcgcttattactgcggcagtccggcagaataaagcaagcgccgtgaaggcccagagtcagagggtgaacacagccaccgttataagacagaatattacatcaaccctttcctcctccggtacaatctcaccgaaggatacgtacagcattacctctatgtcggaaggggaggtggtgcaggcagactttgaggagggtgacagggtggaagcgggacaaatcttataccggattgacgcttcctccatggaatcaaagctcagttccgccagcaacagcctggaacgcgctcagagcagctatgatacggcggtaagcgattataatgaggcggttgggaaatacagcggaaatacttataaagcgacgaaatcaggctatatcaaacagctctacattgaggccggtgataaggttgcctccaatacccagattgccgatatttacaacgatcagattatgaaaatcaaagtgccgtttttaaatatggaggcggcggccattgctcccggcagtccggcagtccttaccttaagcgacacgctggaacagctgaatggcacggtcctgagcgtaagctcgatggatgaggccctgacaggcggccgcctggtccgctatgttacgattcaggtggcgaacccgggaggtctcacggccgatatgacggccacagccgcggttggcgattttgtatccagcggagacggaactttttccgcgacagtggataccgtgctggctgccgacctttcctccaatgtggaggtagaagccctgcttgtcaatgaaggtgattttgtcagcgtgggaagcccgattttcagtatgaaggccagcactgccgagaaactgattaaaacttataaggactccatggataatgcccaggccagcctggagcaggcgcagtcaagtctggattcaacacaggatacatatgatgactatacaattacggctccgatatccggcaccgtgattaagaaaagctataaagtaggagacaaggtacagaacggttcaagcgcttcggccctggccgttatttacgacatgtcctccgttaccttccagatgaatatcgatgaacttgatatcggtaatgtaaagacgggacagaccgtagaggtgacggcggatgcttttgaaaacgagaagttcagcggaaaggttaccaatatcagcctggaaggcaccagctccaatggagtcacttattatccggtgactgtaaccctcgatgaggtgggaggacttcttcccggcatgaatgtggacggcgttattatagtggattccgttgaaaatgcgctggcggttccggccgatgccctccagaggggaaatctggtttacgtgaaggatgattctgtaacagaggcacaggggcgtgtcccggcaggattccgggaagtgaaggtcgggaccggacttatcagttcagattatgtggaaattgtatcgggagatttacaggaaggcgatgtggtatacgtggcaaaatcaagcgttaattccgacagcagcgcgatgatgatgccggtgggaatggatatgccctccggtggcggaggctacggagacggcggtggaaaccgtggaagcggaaacggcagccgccccggcccgtgacagagaggtggaagtatggatgaaaacaggcctttgattgaactgaaagacatttataagatatatcagatgggttcggaggaggtgcgcgccaacgacggcatcagcctgagcattgaaaagggtgaatttgttgccattgtaggtaaatccggcagcggtaaatcaacgcttatgaatatcatcggcgcccttgatgtaccgacagagggcgaatattatctggggggagaggatgtcagccatatgagcgacaatcagctggcagaaatcagaaataagatgatcggttttatttttcagcagtataaccttctgcccagggataatctgcttgaaaatgtagaacttccccttctctatgcgggtgttccgaatcctgaacggaaggaacgggctttaagatccctcgagaaagtaggcctggctgataaatgggccagcaggccgaaacagctttccggcggacagcagcagagagtttccattgcccgggctctggcaggcagcccgtccctgattctggccgatgaaccgaccggagcgctggattcgagaacaagccgggatgtcctggattttatgaaagaactgaaccgggaaggcaatacgatagtcatgattacccatgacagttccatagcgatggaagcgaggcgtgttgtccggatacatgacggtaaaatcaattttgacggggatgtggaagagtatgcggcagtcatttagattagctttaaaaagtatatggagcaataagatgcgttccttcctgaccatgctgggaatcatcataggtgttgccgccgtcatcatcctggtagggctggtcaacggccagatgtcatatatgactgagagcttttccggcatgggaaccaatcagataacggtaaacctggtaaatctgagcaccagatcggtatcggcagatcagatgtatgaattttatgaggataacgaacaatacttcggccagatgtcgcccagcgtaagcgtaaacggaacggtgaaatcaggcaatgaatccctgaccagcacctccatcacaggcgtcagcgaggaatatctggatttgaagagccaggagctgcaggcaggccgttttatccagtattcagatatcctgtccagacagaaggtctgcgtaatcggttattatctggcaaatgagctttacgggggagcatccaaagcgcttggacagacgctcaaggtcaatggccaggcctacgagattgtaggctgtgtggagcgtcagaccagcgaaagcgataacgtggatgagggaggcagcgacgattttatttacatcccctatacggcggcgatgaagctttcaaggaacggaacaattaacaattacatatttaccacgaaggataccggcaatacggaaacggtaaaagcgctttttgatgcgtttctgttccctatatttaaaaacgaagatctctatacggttacggccatgagcgaacttctggattccctgaattccatgatagcaatgatgtccatggtacttggagggatagccggaatctcccttctggtggccggagtcggcgttatgaatattatgcttgtatccgtaacggagcgtacacgggagattggaatcagaaaatctctgggggcgaaaaaaagaacgatcatgcagcaatttgtcatagaggctgccgtcacaagctcgatcggaggtgttattggaatcatcctgggctgtgttctgaccggagccatcggaaccctgatgggaatgaccgccgttccaacggccggctccatcctgctctccttcagcgtctccgtaggaatcggacttctgtttggctatatgccggcaagccgcgccgcacggctgaatcctatcgatgcgctgcgcagtgaataatgtctcaggcagcggggtactgttcacagccctgccaaaaacagttctgcgaccggctgtgaacagtaacgaaagcggacccgcccttgcgtcttcagcgaaatctttattgatattgtctccggaccgtgctaaaatcagcctataagaagctaaaatcaggaggaaacgtgccatgaaatttattgacatgcactgtgatacaatctcgtctatttatcttgacagaatgggcggagaagtgaaaaagttaagggagaataacggccatgtggatctggccaggctgaaaaagggcggctgccttgcgcagaatttcgccctttttactatactgaaagaagatccggatccctgcggttttgcgagaggcgcctgcagactgttcaaggaggaactggcggaaaatgacgatatgatacgccaggccgtcacagttgaggagattctccggaatgaccgcgacggaagaatgtcaggcgtgcttacgatcgaagagggcggaatctgcaacggcagtacggacgtgcttcgggatttttaccgcgaaggcgtcagaatgatgactttgacctggaattatgaaaatgatctggcctatccaaataaggtggatatgaacacgggaatatcgatgccggagacggagcatggacttaagaaaaagggaatcgaatttgttgagctgatggaggaaatcggaatggcggtggatgtgtcgcatctcggggatgccggattctgggacgtggctgagattatgaagaagccgtttgcggccagccattcgaatgccagggcaatagcagggcataccaggaacctgacggatgagatgatccgtaccatggcggagcgcggaggggtgatgggaattaattactgccccgtatttctggatgacagggaagacggcggcacgagccgtatcagcgctatggtgcgccatattaaacatatcagaaatgtgggcgggagcgaatgcattggactgggttcggatttcgacggtatttcgggcacactcgagatagattccccgtcagctgtccatctgctggaggaagcgctttaccggaacggctttacacagaccgaggtggaaaaaattttctaccgtaatgtcctacgtttttacggcgatgtatggaaaaagtaaaatgaaacgtaaaatatgttccggtctttgagggaaaattaaagagaaagtaaaaattttacattcattttacatttccatggtgatgactttacatagatttgatatagtgatgacatactaaaaagataaaagaagataggatgggagaaataacagtatgtcaatcacagatttgggaatgatttttcagtttatcgggggactgggaatgttcctttacggtatgggggcaatggccgacggccttcagaaatttgcgggcaaccggctccagaagctgcttggaatcctgacaaccaaccgggtcctcggcgttctggtgggagcgggcgtcacggctattattcagagcagttccgcaactaccgtcatggtagtcggctttgtcaatgccggaattattaatctgctgcaggcaaccggcatcatcatgggagccaatatcggtacgacggtgacaagctggatcgtatcgatgagcgaatggggcgaagtgctgaagccggaattctttgcccccgttctgttcggggcaggcgcctttatcacactgtttgcaaagagccataagaaaaaggaaggcgctgaaattctgatcggttttgccctgcttttcatcgggctttcctttatgtcaggcgcgattaagccataccgggatgcgccgattttctcagaagcgttccgtgttcttgggcagaatccgattctcggcattttaacaggacttgtagttacggctgtgattcagagcagctcggcatcggtgggaattcttcagactcttgccatcaatggaatggtaaactggcagtcggctatctttatcaccctcggccagaatatcggaacctgtgtgacggctcttttatcctgtatcggaacctcccgtacggcaaagagagcagcggtgattcatcttcttttcaacgtattcggcacggtgattttcggctttgccatgttctttatatttattgccaatccggcctttgcttcatccacggcggacagtgttggaatatccgtattccatacaattttcaatatcactaatacggtactcctgttcccgtttgccggactgcttgtgaaagcgtccgatatcctggtgagaaaaggaacagaaaaaccggtatccacggtggaagcagatatggtgcgccatctggacgacagaattctggagacaccgtcatttgccatcgagaacgccggccacgaaatcatcaacatggctaaaatctcacttgcaaacgtaaaaattgcaacggcagctcttctggaagagaatgaagcgttctgcagagaagtctttgaaaatgaagaaaccattgaccgcatggagaaaattcttacggaatatctgcttaaaattaataacctttccttgaatgacgagcagcatttactggtcaagaatatgtattacacgattggcaacctggaacgaatcggggatcactcggaaaacctggccgaactggcaaggaagcggatggatacccactgttcctttacagattcggggttaaaggagttaaaagaaatctcggatgcggctattcaggcggtagaatgttccatcgatgcaagagcggaaaaagaaatgatgaaaatcaggcaaaccgccaggtgggaggaaacagtggataaccttgaagaagaactcagggaaagccatatggaccggctttccaacagtgaatgcactgtcgaaagcggggttattttcctcgatgccatagccaattatgaacgaatcgccgaccacgcaaagaacgtcgcaggatatgtaaaggaagagatgcaatgaaacatttaatttatgtgatagaagatgatgagaatatcaggaacctgatctgtgtggcgctggaaaatttcggacaccgctcggagggctttgagacggcggaggaagcgctggagcgcctcggcagtatcatgaaacgcggaaaagaagcctacagggagcttccgtccatgtttatctttgactggatgcttcccggcatggacgggatgactgcaatcggaaaggtcagggaattggagccgctcaaaggcacgccggttctgatgctgactgcaaaggatcgggaaaccgatatcgtaatgggacttgataacggggcggacgattatatgacaaagccgttcgggattctggaactttcggcccgggtcagaaatctgctgaagcgatccggcacggtcagggaggaaagcacctgtctggcggccggtgatgtgaaaatcgacaaggagacaagggaagtggtctcctgcggtgaaaaggttgaactcaccctgaaggaatttgagcttttaagctatctgatggagcatatgaaccgggtggtgacaagggatgaacttctggacaatatctggggctatgattatgacggcgagaccaggacactcgatatgcatatcaagacactcaggcagaagcttaaggatgcgggacagcagataaagacagtccgcggagtgggataccgtttcctgaaagaaaaggaacgataacctgcacgctccgcgatgcacagaaacggtaaaaataccgttttacggctgtgaatagtagccataaaatcacagtaaattaccgggctccacagttaataaagatacggggagggacagatttatgcggaaagccatattaaaaaaatttattcagctgctgtttctggctcttgccctgaatacgtttatcttttatgtggtcacaagcagtatgctgctcaaaaaaacacgctccaatatgatgtttgctttggagacggcggacagcctctttgattattccgacgatttgcaggaacaggcagggatgctgaaaaaagtagccgatatgaaccagagccgttttacgattgttaaaaaagacggcacggtcgaggtggatacagaggtaagcaatgcggcagccatggagaaccatatggagcgtgaggaggtaaaggaagctctccagtatggaagcggacactctatccggaagtcggagacccttggaatccagatgctctatgtggccagaatgtcgtcgaacggcgaatacatattccggctggcatccccatattcgggaatgcaggaatatctgatcatgctgctgccggccgtgctgctgagcttcgccattgcattttttgcctcctccatggaagcggagcgattttcacaatccatcaccagacccctacaggatatctcgagggagatgatgaaagtggacggggattatgcggatctgcattttgaccggtgtccttaccaggaaatcaatgtaatcgccgatacgacgacaaaaatgtcccgcaatgtcaaagaatatctggaacgtctggaacaggagaagcagatacgccaggaatttttcagcaatgcctcccatgaattgaaaactccgattacatccatccggggatatgtggagctgctggaaagcggtatggctctgaatgaggagacaacccatgatttcctgaagagaattaagaaggaagccatgagaatgacaagccttgtggatgacattctgatgatctccaggctggaatcaaggggagccaaaacggaaatcgttacaatccaggtggcggatctgctggaggagacggtttcctccctggccacccaggcggcggaacgtggcgttgtgattcataagcagtttgagtcctttgccatcagggccgatttgagacagatgaatgagctgtgcatgaacctgatcggcaatgcggtaaaatacaacaatacggacggggaaatatgggtagaggcgcgcagggaaaacacagactttgtcctgactgtaagggacagcggtgtggggataccgcaggaaagcctgaaccgcatctttgaacgtttctaccgggtggataaaggacgcagccgaaaacagggcggtacgggattgggactggctattgtcaagcatgtcgtaaactattaccacggaacggtacgggtggaatctgaaatcggaaaaggaagtacgtttaccgtccgtctgccggttgcggtgcagccgtaacagtaatttatttaacaggaaagttctcctgttaaataaaaaccgctccgcggaggatcgcgcccgcgggattcgttcttgtaccttcgaaacgggtattttaacctgcttcgaaggtattttttagtcttttgcactttaatacgttgattttttaggaatttaaacaaatgaaattgactccgggcaaaaagtgtagtatgatatgttttaattccagtctggatatgaatttgaaacaatcaggaggagagattatgaaaaaaactaaaaaaattatggcccttgttatggcaggacttatggcagcatccatgacagcctgccaaacgaagacagaaccgcagccgaccggcggacaggagagtgaatcagcgtcagcagaggccccggctggcacagaagcaccggcagctgcaggaaaaacttataaaatcggtattatccagctgacacagcatgccgctcttgacaagacgaatgaaggctttgtggcagccctcaaggatgccggattagactgtgagattgatcagcagaatgcttccggcgaccagtcggcatgccagacgattgccgagacacttgtaaataacggaaatgacctgatttttgcaattgcaacaccggcggcacaggccgtggcaggtgttaccgagacaatcccgattctctgcagcgcggttacggatccggcggcttccggtcttgtggagagcaatgaaaagccaaactgtaatgtatcgggcacatccgacctgacaccggttaaagagcagattgatttaatgcagaagattatgcctgatgttaagagcgtaggccttctctattgttcggcagagtccaactccgtacttcagattgatatggcaaaggaagctcttgaaacggcaggaattgcttataaggattatacggtttcatcctccaacgagattcagactgtagtggaatccatggtcggaaacgtagactgcatctatgcgccgacggataacatgattgcagccggcatgacgacagtggctatggttgccaatgaaaacaagattccggttatctgcggtgaagagggtatggtagacgccggcggacttgctacatacggtattgactattaccagttaggatatatggcaggcgaacaggctgtggatatccttacaaaaggagcagatattaaggaaatgccaatcggctacctggatgcttccaaatgcgctctgaagataaatgaggagacggctgccgaactcggtatcgacgtatcaaacattaagtaattatcagacttggctttttcaggggacggcttatcataatcaataagcggtcccctgaaagcggaatatacgttacagttctgtcttcggccaaactgcaacaaatgatgcgcagaaacggcaaaaaacgccgaaaaaacagcgaaaacaccccgcggaatacatttaggctgaacggttacgagtatacggtatctgagccggaaaaaggaatttagaaaagatatatcggaggaaacagtagatgaatggtttgttagcttctcttcagggcgccgtggcacagggcgtactttgggggatcatggttttaggtgtttatattacgtaccgtctgatggacattgctgatttgaccgtagacggaagttttgcgctgggcgcttgcgtctgcgctgtgctggttgtgaataaacaggtggatcctgttgtcgcactgctggtgtcagccatggcaggtctggcagccggagccgtgacaggcattctgcacactgtttttgaaattccggctattctggcgggaattctgacccagatttccctgtggtccatcaatctgagactgatgggcgggaagagcaacattccccttctcaaggtggagaccttaatcagcaaatttgttaaaatgacagggctgacccagtcacaggcatccatgataatcggtattatcgccgctattattattattgccttcctttactggttttttggaacagagatcggaagcgcgatgcgtgcgaccggcaataacgaagatatggtccgtgccctgggagtcaacacaaagatgacaaaactgctggcactgacactgagcaacggtcttgtgggactttccggcgcacttgtctgtcagagccagaaatatggtgatatcaacctgggaacaggcgctatcgtaatcggtctggcatccatcgtaatcggcgaggtcctgatgggacggcttacctcgttctactggaagctgacatcagtcgtagtcggttccgtaacctactttgtgatccgcgcactcgtactcagaatgggtctggatgccaatgacatgaagcttctctcggctattattgtggcgctggccctcagcttccccgttgtactgtcgaaatacaggctgagaaaagaatatacggagggaggcgacgaggaatgttaacaattaccaatgtaagaaaaacttttaataagggaacaattaatgaaaaaaaggcattgaacggcattaaccttcatctggaatccggtgattttgttacaattatcggaggaaacggcgccggtaaatctacaatgctgaacatgatcgcaggagtatacccgattgacagcggtaagattgtgatagacggaattaatatttcaagggaaccggaacacagacgtgcgaaatacatcggaagggttttccaggatccgatgagggggacggcggccaatatggaaattcaggaaaacctggctatggctctcaggagagggaaaatcaggggacttggctggggaatcaggaataatgagaaggattattacaggactgcgcttgcacaactggatctgggccttcagacgcgcatgacgagtaaggtcggactgctgtccggaggacagaggcaggcgcttacactattaatggcaacccttcaaaagccaaagcttcttcttctggatgaacatacggcggctctggatccgaagacggccagaaaggtgcttgagctgacggaaaagattgtcaacgagcaggaacttaccgctctcatggtcacacataacatgaaagatgccatccagatcggcaaccgtctgattatgatgcatgaaggacggattatttatgatgtgtcgggggaggataaaaagaagctgcaggtggaagacctgctggagaaatttgagacggccagcggtgaagagtttgcaaatgacaggatgatgctggcgaaatagcctttgctgcccgcagaaatcagaggatattaatccccggatttctgcgggcttctttcttacaatagacggaataagacgcccgatgtggaatatatggacaaaaattcacaatttgttaatatttgtaaaagaaaatttacatttacagggagtcaactttattggcaattctttatatttatgataaaatataatgtacgcgttctgataagaaataatttatgtaagaaaaaacgataacctgcacgctctgcgttcaggtcaccgccatcaatgatgaaagacacttatattacgaagtgtcttttgcgtaacagttcatactatttgaactgttactcttttactgccagtcaataaaaatacattggagagattgctgcatgttcaaactaaaaaaagacgattatctggcttccctgaaccgggccagaagaaagagaaaccggggagattataaaaagtacgctctgatagctgccggagctgtagtgataatcggcgccgtcgtgtttgccggccttaagctgggaaacagagagacaggaggaaaaccgggcgagtctgccgaatcggtaaatgagactgcggtgaatcccgaagaggaatcaaaagccacggaagcggcagaaaaaaaagcggtagtggattcctattcgaatctgggaattgtccaggtaaccgggtatctgaatatgcgtgagagtgccagcaccgatgccgacgttatcgggaagctgcagggtgacagcgcctgcgagattcttgacgattccacggaaggctggtatcagataagctccggcgggctgaccggttacatcagttcagaattcgtcctgaccggcgaagaagcaaaggccaaggcggaggaactggttgccctgcgggccattataacagtggatgccctgaatatcagaaaggagccgaccacggaatcggatgctgtgggacaggcccttaaaaatgaacggtatgtgattgaagaagacaccggtgacggatggctgaaaatccccagcggatatatagcctccgaatttgtggaacagaaatatgcgctgaatgaagccaggaaactggatatgaagtcgatggttttaaatctttataagaatatcggtatttccagcgttgacaattatctgaatgtcagagaagaacccagtgaggatgggaaaattatcggtaagatgacaagtaagtctgccggtgacattcttgagacgacggaagacgggcagtggtacaagatacattccggcccggtaaccggctatgttaaggcggagtacattctgaccggtgcttcggcaaagaatgaggcgctcaatgtggcggagctgatggccattgtttcaacggaccgtttgaatgtaagaaccgaaccttcgaccgaatcccagatatggactcagatttccaataatgagagatatgcggttctgagccagaccgacggctgggtagagattgagctggacagcacgtcggcctatgtatcaaccgattttgtggatgtccggtatgcccttcctgaggcgattaaattctcgccgctggatgcaaatgtttctctcagaaataaaattgtcaactatgcccttcagtttgtgggaggaaaatatgtatggggcggcaatgaccctcatacaggagccgactgctccggctttacgaaatatgtatacagcaaggtggccgggataacactgaaccgtgtatcaagggatcaggcaaaacagggcaaacagattaagtcctctgaaatgcgtccgggcgatttaatcttctatacaaacagtaagggaacgatcaatcatgtcgcgatgtatatcggaaacggccagattgtccatgcggcaagccggcgaagcggcatcaagatttctacatggaattaccgtaatccttatcgtattattaatctgcttggtgattagatgaggatttaactgaggttaggaggacgcggccggaaccgactatgtccggtgtggtgagggggaagctggctgagtcttccgtccccggttggagggttaaaaataaaaatctttttaaaggttatagacttatagcctgtgatggttctgatataaatatcgcgcataatccggatgataaagaatcttattttacaaacggaaatgcccggggatttaaccagttgcatcttaacgcaatatatgatttattagataagatttacacggatatcattatacaaccgggtaagattgaaaataaacacaaagctttttgcgatatggtagaccgatataccggaatacgaaacacgctctttcttgttgatagaggctacgagtcatataacaatcctgcacatgtacaagaaaaaggtgctttttatttgtttagatgtaaagatatcaatagcagcggaatattgtcacagcccacgttactataaccaaatgtacgaacaggcacgtgtatcaaatcaataatacatttgccatacacatatgcaaatattttataagtaaaatggcggagaaatctccgccagatgtagaagcattgataagtaaagaaattttacctgttcgtcctggacgtcacgaccctcgcaaagtcgatcacaagaaagcagttagttttctatacagagtagcttaacatcaaatatattatacaactttttgaagcagatgaaaacatctatttcaatgtgttgctctaaaaaatccatagtgccggaaaaaagaatcaccctatccttgtttttaataaaaacagaaatagggtgataattatgtcttgttatcttaatgacattgcccggccgctgattgtctcgcgcgttaagtgcgggggcggaccttgtcgagaccactcagcgctactaccatgtacgggaaatactatatgccatcaatgggcttataaaaaaataacggaagatattgatatcggcctgccggaaacacgttgtggccgcgacaaggctctccctatttaaggttagagacaatcagcgcccggaacggaccatgtccggtgtcgcgaaaacttccgcctgagtcttccgtccctgcgaaaccttgaccgggggaaggaggcggaatcaattctggaggggatatggaagcccatccgtgcttaatgaggtttctcacgaatttagcacggctatgcgcttcgaaaagtgcaaacggtccccgtaagaattcattccggccggattccccctcacgacaccctccaaccggggacggaagactcagccagcctcctcaccacaccggacatggtccgttccggacgcgtcctcctaacctcagttaaatccccttttataaattgtaagttttttatagtcgcattttctgacaaaatatgatataattctttctgaatcgtatgttttgtaacaaaaacgtaataatttcaaaggtttggagagagatgaatggcagagcagaaatcagatgattataaaagcaggctaaataaggcccgtaataagcgtaatggaaaagatccgatgaaatattttatgtatgctgcaggcggtatcattgttattcttctggttgttgtggctgtgaagctggccaggggaggtactttcgcaggctcacccaaggcgagaatggtgaatgagacagatacaggagaagccgctgaccaggatgcctcaggggaatcagagagtgtggattcggagaatgcggagcctacgatgtcacccgaggaactggcccaggcggagacggatgcccaaaagaaaagcgtcgtggaatcgtataataatctgggactcgttcaggtttccggatatctgaatatgcgtgagagcgccagcaaggatgcaaaggtaatcggcaagctgctgggaggaagcgcctgcgagattttagatgattcgacggaaggctggtatcagataagctccggcggattgaacggttatatcagttccgagtttgttctgaccggggaagccgccaaggaggaggcgtttgaacaggtgaaagaaatggccgtgatcacagccgacaagctgaatgtccgcagtgaaccgactccggacggccagattgtggagcagatcctgaagaatgagaggtactctattctcggccagcaggatggatggatccagatcagcgacggttatatttcttccgattatgtagatatccgctatgcactcaatgaggcgagaaagctggatttgagaaccatggtattgaacctttatgacaacctcggtatatctaatgtaaacaactacctgaatatcagggaagaaccgaaggaagacggcaaaattatcggtaagatgacgagtaaatcggccggagaaattcttgaaaagacagaagacggagagtggtataagattaaatcaggccctgttaccggttatgtcaaatccgagtttatcctgacaggcgacgctgcaaagcaggaggctcttaatgtggctgaactgatggcaattgtctccacagaccgcctgaatgcaaggacggagccgagtacggaatcaccgatatggacccagatttcaaatagtgagcgttatgccgtcttaaagcagatggacggctgggtagagattgagcttgactccaccagcgcctatgtggcaactgattttgtagacgtgcgttatgcgctgaatgaagcgatcaagttcagccccatcgtagaaactgcttcttcttccggcggaaacaagggcagcagcgggaacaaaggcggaagcggcggcaataagggcggagtgggtaatacaccgggtaatgcagccggttcctcaaagagaacccagattgcaaattatgcgacccagttccttggcaatccatatgtgtggggcggtacaagccttacgcggggagccgactgttccggattcacgatggctgttatggctaattttggtgtcagcttaccgcatcattccggttcccaggcgaactgtggcaagtcgatcaattcctcacagatgagaccgggtgatttagtattttacgcaaacagcagcggaactattaaccacgttgccctctatatcggcaacggccaggtatgccatgcatccaacgcaagggacggcatcaagatttcaacctggaattaccgtacgcctaagaagattgtcaatgtgttaggtgattaaaatagccgaatgccagagcgtgattgaaaattgctttttgtcagctgtgcatcacactttgtgggagatttggaccgaatgagcgcggcgtagtgggctggaacagtttatgctgtctggactgtgacagcatgaaagaagtatagaggaggtatcgtatctgagacataatctgtccagatgcgatacctcttttttgccgcggcgttgaacagccggtatctgtattttatctttccgtcagtaatggttcgctgaagatttccttcattgcctcgataaaaacatggtctgccctggataaaaaagagccggctgatgttccgacagagagatcccaatacgctttatataccgggggaatggaaaaacaggaaaatgccgcatctaccatagtcagtttcgaatactgactggggatgagcgttactccggcgccggaagcagccagaagctgggctgttgcaaaattcttcacggtcaggcggatgacgggctgggttatcccggcacgttttaagatggaatcactcacctggcggatccgctgggaggagggcagcatgataagcggctctttggcgaggtgcctgacgtccaaaacggggtatattgaaccattgtcagacacggcctgttctgccagagcgcacaggtgggaatcctttcccgctacgatcagaaaataatccctggaaagaaaatgatattccagctggggattggcggattccttgggggcgtgcgttataataaaatcaaccttgccggctgtcagaagagcttccagccgatcggaggtctcttccgtaacagttatctcgatggaaggatattgctccataaaccgggggaggattccgggcaggacgacagttcccaggtggcttgtgatgccgatatgaatgcgtcctgttttcatattattgatatcgctgatctccagttcgaaattctcgtacattttcagaatctgaagagccatatgataatatttttcaccggcatacgtcagggtaagcccggtagaggcccggttaaacagaggggttcccagactgtcttcaatccgtttaatatactggctgagggacggctgggcgataaaaagctttttggcggcctgggatatgcttttctcatctgctactgttttgatataaatcaattcccgctgggtcatctgagtctcctttccataataaagcggcgctttctgtgagatgaattatagatgaatttatagtataggataaataatatatactatataatttatataatatttgtactatgattaaaaacattatataataaaacaagataaaaagaaagtacaaatcgatcttatcacattcgggaggtatcacatggtaaaactgtatgagggcggagtatatcttttaaacggcgaggaattgattgaagaaaaagaaagcgccagagtggaacagataacaggcagaaaaatttccatagaagaagccagaaagaacacgattgcctattcaattctgaaagcgcataacacatcagactctatggagaatcttaaagtacgttttgacagtatggcatcccatgacattacatttgtcggaattattcagacggcaattgcatcgggaatggaacgttttcccctgccctacgtgcttacaaactgccacaattccctgtgtgccgtaggcggtacaatcaatgaagatgatcacatatttggtctgtctgcggcaaagaaatacggcggtatctacgtgcctccgcacattgccgtaattcaccagtatatgagagagatgatggccggctgcgggaaaatgattctcggttccgacagccacaccagatatggcgctctcggtacgatggcaatcggagagggcggcggtgaacttgtaaaacagcttctttgcgacacatatgacgttgcctgtcccgaagtggtcgcagtgtatctcgacggaaagccgtccccgtttgtagggccgcaggatattgccctggccattataggagctgtatttaaaaacggatatgttaaaaataaggtgatggagtttgtgggaccgggcgtttccgagatggatacggactacagaaatggaatcgatgtaatgaccaccgagactacttgtctttcctctgtctggagaacggatgaagatacaaggcagttcctgaagctccatggcagggaagacgattataaagaactgaatccgggcgggacggcgtattacgacggagccatctatgtggatctgagtacggtaaagccgatgatcgcgcttccattccatccgagcaatacatatgagattgatgagctgaatcacaatctggccgacattctttcagaggtagagaaggaggccgacaggatagcggggcgcgaaggttccctgagactggttgataaaattgttaacggcaggctccaggtgcagcagggcgtcattgctggatgcgcgggaggcaattataccaatgtgatccaggcagcacatgcgcttcgcggcagaaactgcggcaatggggaatttacactctccgtatatccttcctcacagccggtgttcatcgacctggtgaagaaagatgcagtcagcggactgatggaagcgggagccattatccgaaccgctttttgcggcccgtgttttggtgccggtgatactccggccaacaacggactcagtatccgtcacacaaccaggaacttcccgaaccgggaaggttcaaagccgggtgcgggacagatggcaggcgtggccctgatggatgcccgttccattgcggcgacggcggcaaacggcggaatgctcacctctgcagagacaatggactgctggggagatgtgccggattatcactttgacgacacagtatataagaacagagttttcttcggctatgacagagctcaggaaaaagaggaactggtatgcggcccggacattaaggcatggcctgagatgagtcctctgaccgataatattcttctcaaggtatgctcaaagattatggacgaagtcacaacgacggatgaattgattccatccggagaaacctcctcataccgttccaatccgctggggctggctgaatttaccttatccagaagagatcctcagtatgtgggacgtgcgaaagaagtaaatgagctggaaaaactcagaaatgcaggtgtgaacccgtctgagaaagcgggagagcttgagaaagtttttgaggggatccgcaaggttcccggcagtgagaatgtaaaaccggaggaaacggaaatcggaagcatgatttatgcggtaaagccgggggacggttcagccagggagcaggccgccagctgccagagggtactcggagggcttgccaatatcgccagagaatacgcaacgaaacgttaccgctccaatgtaatgaactgggggatgataccgtttctgatggataaagaaccggaatttgaggtcggagattatatttacattccggatatcaaaaagattctgaacggtgatttgacagatatcagagcatatgtgattaaagatgaagttcaggaaatccggctccacatcgctgatatgacgcctgaagagcgggagatcgtgaaggcgggatgcctgattaactataaccgtaacagataaataaagaaacaggaagcagatatataaagaggcaatgcataaaaggcatgccggggatgataaacaatctccggcatgccttttatgttcagctgcagggccgttattttagtaatgagtcacctggctgctttcctgaatccgctttacgacttcaccggcttcctccgagagaaaataccgcagggtgctttcagggacaagctcccgtatctcttcaagcctgccttcatgtattttccggcgcaccgtggaagcgctgataaccccggatgcagccgtccttcttgggataatccggcattccacgccggacaaaggcagttcggcggccataatttcgttatatatccctgttacctggctggccggttcttccccgacataacgcaccgtgatatcaagagatttggcaatttggccgaatatagcagtatctaatttcgcgtgggtgcggattaccgtatccttatccttcaaaaaataggagggaaaggtggcattggagattagatagcttccggtctgatggaaaacaaggtttttcagatgggcgctgccttcctttaccaggttatagcgcacgtcaaatgggacgagggaagcatcctccgatacaataaaaacatgaagcagacggcaggcggccgctgccgtggcaagcagataaagatggcccagagtgaaaggattggcattcatcaccacggcgccgacaggaagacctgcctccggttgcgcgtctgattgttgaacctgttcctgtgtttcctgataaaggttatcaagataggaggcaaaaccgttttttctgttttccatgaaaacaactctgccgtccgcgcgggcaacttcatagaagccgaggtcacggaagaaaagcgccttatcatatttcgtatagagaaacagatttaccgttccctgttcgaattcgtattggattaaatggctgaccacctggtttaaaagaccttccccctgatgaccggaatccacggccatgcatcggagggtgttggcaaagcaggagcctgttgctgcaaggttgtaatcgtcgtcgtataaaccgatggtgtaatccaggttatcatcgcgttcaattccttctttttccagaagggcgtccagttttttcatttccctgcgatcgttataaaaaattcggctgatgtgatattctgacataaaattctccatttcctttattaaagcggacgactgacatccacacttttcgctgtacttccagaactaaatccggtattcctagtataccggattttgtctccggccacaagaggccgaatccggcttttcgatgaacagtaacgtatattagttacagttcaccccacgccaaaaagcggcgtgctgcgaacaataacacgcttcgcgatgcacagaaacggcaaaaagcgccgttgattgtggtgaaaagttcacttttcatcgcgtcgcgccgtaaaactcgggattttcgtgcaaaatgcgtacgaaaacacctcgcggaatacaaccgtgtgaacagtaacgtatattattcaaataagaacacagaatatcataaaatgaataaatttggaatgaggaggactgctatgctggtgcaggaattaaatgaacggtcacatgattttgctggtagaaataataagcaggagaataaaagggagaatacggagacccagagaatgaagaactccggtaatgagccggaacaggaacaacagaaaattaaaaatgaggaggccagggaagaacggattaaagaaaccggccaggtacttctggaggagggcggagagggcgctcatatccacctgatttccatcattggcgagattgaaggccatgaaaatctgtcgggaaatacaaagacaacaaagtatgagcatatcctgccaaagctggctgaaatagaagacagcagggaagtggacggagttctcgtcatgattaacacggttggcggcgatgtcagctgcggcctggccctggcggagatgattgcctccctgagcaaaccaacggtatcccttgtaatcggcgacagccattctatcggagtccctctggccgttgcgacggattactcctttatcgtacccacagggacgatgatgatacatccggtcagaatgtcgggaaccgtgatcggcgctgttcagacatacgattattttgaaatgatccaggacagaattcttaactttgtttccggccattcccaaatcgcctatgatcaattgagacgcctgatgctcaatacggaaatgctgacaaaggatctggggactgtcctggtcggcagcgatgcggtaaaggaagggctcatctgcgaggtgggaggaatccgtgaggctcttcaaaaattgaaccggatggttttagagagaaaagagatttagataagcaggtgaggacgccgccgcaggccagcggacggggttgtggagtggttttatgagtatttcgtcccgggggaaggattgttgtgagtttggactgcggagaagctatagtctgcggagcacgttttcactcggtggaatgcatcgcgctgctaagctcgagaggacctcgccaatcagcgatggattccaaaggcatccgcagactatagcttctcctccgccccagtgacaggtggtcgccgggacgaaagactccgccgggtgtatcggcccagtccgctgacttgcggccgctgaatgtctcacgcgttaagtgcgggggcggaccttgtcgctgccactcaacgcatccatatgcgtagtggcagcgacaaggccccctaaccctttgaggctggagacaatcagcggccgaaacggaccggggccgcgaaaaccttcgcctgagtctttcgtccccgaggaaaacctgaaccggggaagtaggcggaatcaattgcggaggggacatgggagtccgccggtgcttagcgaggtttcttacgagcttagcactgatgcgcactccaaagagtgcaaacggtccccgcagcaattcattccgaccggattccccctccacgaccaacctcccacggggacggaagactcagaaaaaccagactcaccacaccggccccgatccgttccggacgcgtcctccattctcaactaaatctccattgcttttttcctcatttttttgtatactatgctaagtagaagatagaaaatatgtttggaggcttagagacagtggcaggcacgagcagaaagaaacaggatacgggcagtaggaagaagcaggcaggtacagcgggtacaaagcgttcaggcacgggaagaaaaaagacggcgccggccgtcaatgagaatagttttatggggacagaagtggcgattattgtatcatttgcagtatcggtgcttctgtttttgagcaattttggactttgcggagcagtcggcgatttttgccggaaggtgatgcttgggatatttggaagtatgggatatgcggctccggtacttctttttttgggaacctgtttttatatgtccaacagaggaaattacagggcatttttaaaaatgggggctgtggctgtggtgcttctcgcactgtgcggccttgatcagatgatgtttggcggcggaatgaaggagggctggaaattaagccagtactacgtccagtcgggagccggcggtgacggaggcggttttgccggcggtgcgcttgtcatgatcttaagctccgcccttggttcggttggaacttatctcgttcttatcgtggccctggttctgggcgccgtatgcatcacggagaagtcgcttgtcagtctggtaaagaaaggcagcggacgtgcctatgaatatgccagggaggatatgaacaggagacgcgaaatacacgaggagcgcagggaagagcgaaggcgcatgagggaggaacagcgtgtgcggggcgtggatcttgacgctactaatttaaatgacgttccgttaatgagagaatttgccgccggaataccggaaggaaccgtcctggcggaggatgcaggacaggaattccaggaagacgacaggcagtttaagacagatgggaaagacagggaagtgtccgccggacgtccccagaatcctgccgatatattccgcgggagtattgccctgcctcagtatgatcccgaggcggacatggaagaggcagaggagacaggacaggctgaggcaaaagctgctgcctctgatgaaaccggtaaaaggcgaaagagcaggaaaggcagtccgcaggaggatacggatgatatcctgaagaatatttacgtcagacgggatacgagaaccttcgaggaattttccggggaggaacgggagataggcggaaggcatcccggatttaccgcggtacccgcagaagattatggtgaaacggaggtcccatgggagaacacggatgcccgggacgtctatgattcggaagtccgcccggagccattcggggaaccttatccggaagccgggcatttcgacgattcggagcaggtggaacgcttctatgaagattgtgagggtacggagccgtacggcagcgccaaagcgtattaccgggaagaagatttatccgttaacggcagtgattcggagcaggaagaggggctcaattatgacggcttctatatcccggaagagcctaagactgttgtgaccgcatccggcaaaattattgagacggatacggagatggtgcgcaaaaccatagagaaaaagagagtagagaagaaatctcagccggaggatgaattatcccttaatgaacagatagagaagcgggcagaggccgccaaggttgttaagaaagaatacatagtaccgccgttgaatctgttaaagaaaggcgcgaaaaacagcggaggcttctcggaaaaagaatataaagagaccgccatcaagctgcagcagacactgcagaattttggtgtgggcgttacggttacgaatatcagctgcgggccgtcggtgacccgttatgagctgcacccggaacaaggggttaaggtaagtaagattgtcgcgctttccgatgacatcaagctgaatctggcggctgccgatatccgtattgaagcgccgatcccgggcaaggccgccgtggggattgaagtgccgaacaaagagaataatgtggtgcttctgcgggagcttttagagtctgaggatttcaagcgccacggttcgcatatggcctttgccgtcggcaaggacatcggaggacaggtggtggtcactgatattgccaagatgcctcatcttctgattgcaggcgcaacgggttccggtaaatccgtatgtatcaatactctgattatgagcgtgatatacaaggcaaaaccggatgaggtgaaactgattatgatcgatccgaaggttgtggagcttagcgtttacaatggaattccccaccttcttatccctgtcgtaaccgatccgaaaaaagcgtcgggagcgctgaactgggcggtggctgagatgaccgaccggtataataaatttgccaaatataatgtcagggatcttaaaggctacaatgcgaaaattgagtcgattaaggatattgacgacgacaataaaccggaaaagctgcctcagattatcattattgtggacgagcttgcggatctaatgatggttgctcccggagaggtggaggattccatctgccgtctggcccagctggcccgtgctgccgggatccatcttgtaatcgcgacgcagcgtccgtcggtaaatgttattaccggccttatcaaggcaaatatcccttcgagaattgcattctccgtatcctcgggcgtggattcgaggaccattatcgatatgaacggagccgaaaagctgctgggcaagggcgatatgctgttttacccgtccggttaccaaaaaccgcagagggttcagggagcttttgtgtcggatcaggaggtgtcacgcgtggtggaattcttgacggagcagggaatgacggctgattataatcctgaagtggaatctaaaatcagcaccgcgtccttcgcggaaggaccgtccggcggaagtgaccgggacgcgtattttgtccaggccggccggtttattattgaaaaagaaaaggcatccatcggtatgctccagagaatgtttaaaatcggtttcaacagggcggcaagaattatggatcaattggcggaggccggtgttgtcggcgaagaggagggtaccaagcccagaaaagtcctcatgacgatggaacagtttgaaaatatgatgaacgaataagcattaaaaaattacagcgaataagcagaggacggaaacacgatttaattccggaatgcgtatgataggatcaggaggaattatgaatgaaactgagagaatggcttaaggaaatggaatatgagctcctgcaggggaatctggacgaggaggtggatgacgtcgtctacgattccagaaaagcggctgccggttccgtatttgtctgcatgcggggcgccaatgtggattcccacaaattcatcccggatgtaattcagaaaggcgcaaaagtgcttgtaacggaggaagcggtcacagtccccgaagaaattacagtactcagggtcgggaacggcagaaatgccctgtccctgctttcggctgcccgctttggttatcctgccagaaaaatgacgacgatcggcgtaaccggaacaaaggggaaaacgacgacaacctatatgataaaggcgatcctggaagcggcaggtgagaaaacaggattgatcggcacaaatggggcgattattggaagcgaccattttcctaccatgaatacgactcctgaatcctatatactgcaggaatatttcgcaaagatggtggaacagggctgccggtatatggtgatggaggtatcctcccagagctatctgatgcaccgggtggacggaatctttttcgattactccatcttccttaatatttccaacgatcatatcggtccaaatgagcatgccagctttgaggaatatctgtactataaaaaactgctgctgcagaacagccgtgtctgccttgtaaacagggatgacggacatttcagggaaatcatcgaaggtgcaaaagcggaaataaagacattttcaatggagcacagtgcggatttcagggccgcagacgttaaatacataagggaacatgactttgtcggactggactttaagatggagggggattatgagagcaggctgagagtgaatgtcccggggctctttaacgtatataatgcaatggcggctgccggggtatgcagctgcctgggactttctaaagagcgggtggcccatgctctggagcatatgcaggtggacggccgtatggaaattgtctataaatcggcaaaatgcaccgtgattgtcgattatgcccataacgcagtcagcatggaaagtcttttgatgacgcttcgcgattataagcctaaacggcttgtggttgtctttggctgcggcgggaaccgggccagggacagacgctattcgatgggagagattggaggaaagcttgcggatctctctattattacggccgacaattcccgttttgagaagacatccgatattctggccgatattaagaccggtctttcaaggacagaaggaaaattcatagagattcccgaccggcgcgaggcaattgaatacagcctgtcacatgcgcaggagggggatatcattgcgataatcggcaaaggccatgaggattatcaggaaatcgaaggtgtcagacatccgtttctggacagaaccgtggtgcaggaagcagtgcaaaagcttgggatgtaagtgtggcaaagtacgattataatatataacaggcagaaatgccaaaaataatgtctggagtaacagaaaatggaaaatatcagaataagagacatcgtggaggcggtaaacggccgtctcctttgcggcgatatggaaacatccttaagacatatcagcattgattcgaggactatgaagggggacgatttgtttgtccctcttatcggggaaaaagcggatgcccaccgttttttaagccaggcgttcgaaaacggcgcggccgcgtctctgacctcggagcatgacacatgtcctgagggcataacaggcgccctaatacgggtggaggatacaaaaaaggcccttcaggacattggccgctatatcagaagccgcctttccctgcccctggtcggaatcaccggaagcgtgggcaagacgacgacgagggagatgatagccgccgccctttcagccggatacagaaccttcaagacacctgccaatcacaacagccaggtgggagttccgattacaatttccgatatttcggaggcagatgagatcggagttctggagctggggatgagtgaaccgggggagatggaggtaattgcagacattgcccgcgtggacacggccgtaatcaccaatatcggggttacgcatatcgaaaatcttggctcccgtgagaatatcctgaaggagaaactccgtattcaggatggaatgaagaggggcggaaccctttttctgaatggggataatgagctgctgcgggatgtccgggcaaaggacggctgtgagacttctttttacggacttggtgcgaattgcagctaccgggccgtcaatatcacatataacggaggccgtccggcattcgatatggtacacggcgctgcggtggtgccggtcgtccttgaagtgatggggaaacacaatattctcaatgcgctggccgccctggcagtagccgatcattatcatgtgccgctggccgatgccgcagaagcgcttaaaacctttgatggttttaaaaaccgccagcagatttatgaaaagggaaacataacgattatagacgacacatataatgccagccctgactccatgaaggcgggaatccgtgtcctggcatctctgacggacaggaagagaagaatagccgttctggccgatatgaaagagctgggagaagatgctccgttattccattatgaaataggagctttcctgggagaacagccggtagaggaagtcataacttacggagcgctggcaaaggaaattgccagaggcgtggaagggaaagtaaagacaaccgtgtttgaggaagagcagaaggaagagatgacggaatatcttgagaagctgctgcgggaaggtgacgcagtgctttttaagggttcgaacagcatgaagctgggagaaacggccgcacgctttatatgagagaagggcttttcagcgttaaagaggagacagacgataatgacgagctacgcctatgccgatgtaatcattgatatatcccacgagaaggtcgaccgtgcgttccagtatgggataccaaaagggctggaagccgaaatttatgtcggagtgtgcgtccgtgtgccttttggaaaaggcaatgtgacgagaaagggctatgtggtaggtttaagcaatacgcctgaatttgatacggagcggatcaaagagatagctggggttgtgaccgggagcatatcggtccagtcccagctaattcagcttgcatggtggatgcgtgaaacctacggcgccacaatgaaccagtccctgaaaacagtcctcccggtaaagcagaagatgaaacccaaagaaaaaaagagcatccgctgcctgctggacagtgaggagcttgatattgcgatacgggaagcggaaaagaaaaatcataaagccaggctgcgcctgttaaatgcatttagagagacgtccgtgattccttcggagatggccgagtcgcagcttcaaatcacaccgtcgaccttaaaaccgctgatagacaaaggccagattgaaatcctgaccagagaaatttacagaacgccgtttaaagagctttcccataccggccatgccgctatcctgaatgaagaacagaaaacggcggcggaccggttcatccgggattatgaagaaggtcaccgggacacctatcttcttcacgggattaccggcagcggaaaaacggaagtatatatggagttgatggaatatgtattgaaacggggacagcaggttatccttctgataccggagattgcactgacctatcagaccgtgatgcgcttttataagcggttcggcgatcagattgcgattatcaattccaggctgtcggccggggaacggtatgatcagtgggaacgggcggcaaagggtgaagtatccgttatgatagggccgcgttccgcactgtttacgccgtttcaggatctggggcttattataattgatgaggagcatgagggagcctataaaagtgaaaccatgcccaggtatcatgccagggatgtggccgcagagagagccaggctatgccgcgcggcgcttgtgctgggctccgcgactccctccatggaggcgtataccaaagccatggcaggagaatataagctgctttccctgaagaacagggcggcaagcggcagcgcgctttccagcgtggacgtggtggacttaaggaaagagatgcaggaaggcaacaaaagcatgttcagcagacggcttaaggagctgattgaggacaggctcagaaaaaaggaacagattatgctcttcatcaacagaagggggtattccaattttatttcctgccgctcctgcggggaggcggtgaaatgtccccactgtgacgtttccctgacgcttcacggaaccagccgtctcgtatgtcattactgcggctattcggttccgcttatgaagctctgtccctcctgcgggtccccttatattgccggtttcggcgcagggacgcagaagctggaggaactgacgggaaaggcgtttccccaggccaggatcctgcgcatggatgccgatacaacggccagaaagggcggccatgaagagattctggcggctttttcagcccatgaggcggatattctgattgggacgcagatgatcgtaaagggccatgattttgggaacgtgacgctggttggcattatggccgccgacttgtccctgaacacgccggattaccggtgcagcgagcggacgtttcagcttcttacccaggccgcagggagagccggccggggaagcctgtccggcaatgtggtgattcagacataccagccggaacactatgccatcgttacggcggcagaacagaactatgaagaattttaccgcagggaaatgctttaccggaaaatgatgaactatcctccggcctgttacatggaggcggttctgtttgccggaaataatgaaaagacggtggagcgctgttctgaccttgcgcttttgacagtgaggaagatgggatatgaagaaaatgagatacagatgatcggcccagtcagggccccggtctacaaagttaatgatatatacagaaaaattttatatataaagagtaaaaattgtgatatacttgataaaatcaggagaaatatcgagttgctggcagccggggatgaaggatttaaatcgctggccctgcaatttgatatttcataagctgacatatggaggaaaagaaaaatggcaatcagatcaatcagaacaatgggcgatgaagtcctcacgaaggaatgtaaaccggtaaaggaaatgacggaacataccgccgaattgatagaagatatgtttgagacaatgtatgaggccaacggcgtcggcctcgccgcaccccaggtgggaatcagaaagcagattgtcgtaatcgatgtggatgacggcaaccagtatgtgctgatcaaccccgagattgtggagacggaggggagccagaccgggtctgagggatgtctgagcgtgccggggaagaccggtgtcgttacacggccggagaaagtaaaagtaaaggccctgaacgaaaagatggaagagtttgagctggagggcgaaggactgcttgcaagggcaatctgtcatgaatgcgaccacctgaagggccagctctatgtgagcctcgtggagggcaaactggaagatgtgatgatggaagaggtagaggaataagatgaagattgtatttatgggaacacctgatttcgcagttcccactctggaggcgctgataagaggaggccatcaggtggccgccgtcgtaacccagccggataaaccaaagggcaggggcaaagcggtgcttatgactcccgtcaaggagaaggcaatggaatacggtattcccgtttaccagccggccagggtgaagcaggatgatgaatttttccaggtgctgaaagcgctttccccggatgcagtcgtcgtgacggcattcggccagatacttccgcagcggattctggagcttccgagatacggctgtatcaatgtccatgcctccctactcccgaggtaccgaggttccgcaccgattcagtgggccgtgatcaacggggatcgggaaaccggcgttaccacgatgatgatggatgccggcctggataccggagatatgctggagaaaattgtggtggaactggatgcgaaggagaccggcggaagcctgttcgaccggctcagcctggccgggggcgaattaattctctccacccttgaaaaggcggagaaaggcacgcttgtcaggacaaaacagccggaggaaggcgcatgctacgccggaatgcttgacaaggctcttggaaaaatagactggagcagggacgcggaggccatcgagcggctgatacgcggcctgaatccgtggcccagcgcctatactgcctttgagggcaggacactgaagctgtgggaggcggaggtgacggatgagtgcagtgacggacaggatgagtatggcaggattgtcaaagtggaaaaagacagctttctcgtcaaaacgggaaagggctgcctcagaatacgccagctgcagctggaaggaaaaaagaggatggatacgtgtgcttttctgcgcggatatccggttaaagaggggattattctgggataagaatgtaacagtttgatgaaatgcctgactattttggattttcgaaaggagttttattatgcccggatatggaatgggatactatcgtttttttgatcctacaatgatacttgttttaattggagttgttctttcgatggcggcgtcggccaaagtccagagcacctttgccaagtattcccgcgtcagaagcatgacggggatgaccggcgccgaagcggctaaacggctcctgaattcccaggggatttacgatgtacaggtccgtaaggtggcgggaaatctgactgatcattacgacccgaggaataagacattaaatctttccgaatctgtctacgattcgccgtcggtagcggcaatcggtgtggcggctcacgagtgcggccatgccatccaggacaacacggaatacgcacctttaaaaatccgcggcgctattgtgccggtagtaaatatcggaacccagctttcctggcccatgattcttctgggcgtattattcggaggcctgggctctccgctggtacagattggaatactgctgttcacgctgtgcgtaattttccagcttgtgacactgccggtggagtttaacgcctcctcacgcgccgtacggcttctcgacgagacgggaatcctgtccggagaggaagtgggatatacgaagaatgtcctgggagcggcggccctcacctatgtggctgcggcagccggctctattttacagcttctgcggctcctgattctgtttggaggaagaagagatgaccgttaaagaaccggcgctgcgggagatcatcctggatattctgctggaagtactggaaaaaggcaaatacagccatgtgatcctgtcacaggcgcttacaaaataccaatacctggaaaaacaggaccgctccttcatcaagcgtgtggtggacgggacggtagagtaccggattcagctcgattatatattaaattcatattcgaaagtaaaagtaaataaaatgaaaccggtgatccgcaccattctccggatgtccgcctatcagatctgccatatggaccgggttccggattcagccgcctgtaatgaagcggtgaaactggctgaaaaacgcggtttttccggtctcaagggctttgtcaacggagtccttcgaagcatttccaggggaaaagacaatctggtgtttccggatgattctatccgctattccatgccggaatggctggcctccatgtggaaatcaacatacggtgaggaaacgttccggcggatgatggagagctttttaaaggaccgccccctgatggcaagattatgcctgaaccgggcggaaaaacagcagatcctcgattctctgggcgctcagggcgttaccgcaaaggacagccgttatgccgatgacgtaatctgtctggagggagtcgattatctggagggacttgaggcattccgggagggctggctccagatacaggatttgagttcttccctggccggcgatgcggcggggatcaaagacggagattacgtaatcgatgtctgcggcgctcccggcggcaagggacttcatgcggccgatatcctgggaggcaccggcatggttgagatacgcgatatcagcgaggcaaaggtatcgctgattgaagagaatatcggcaggagcggtctgacaaatttaagggccgccgtatgcgacgccctttcctttgatcctgattcggaggaggccgccgatgtggtaattgccgatctcccctgctccggccttggcataatcggccggaagccggatataaaatacaatatgacgcccgagaaactgcatgatctggcctgccttcagagggagatactctccgtagtgcagcggtacgtcaagccgggcgggacgctggtttacagcacctgcaccgtcaacagagaagaaaatgaagataatatgcgctggttcctggaacattttcctttcgagccggtgaatctaaaagggcgtctcggagaaaaactttcggagccgtctatggagtctggatatatccagttccttccgggaatccatccctgcgacggattttttattgccgtgatgaaaaagtgcggctaaggagtgttatgaacaaaactgatatcaaatcgctgacgcacgaagagcttcaggatttattaaagggaatgggagaaaaaccgttccgggccggacagctctaccggtggatgcatgaaaaactggctgcttcgtttgacgaaatgacaaatctttcaaaggatctgcgcgggaagctggcagagaactgtacattcacggcgcttaagccggtatgcgtaagaatttcacaaattgatgatacaagaaaatacctgtttgaactggaagacggaaatgtgatagaaagtgttctgatgaaatataagcatggcaattcggtctgcatttcctctcaggtcggctgccggatgggctgccgtttctgcgcctccacccttgacggcctggagagaaacctgactccgtcggagatgctcgatcagatttaccggatacagagagacacgggagaacgtgtttcaaatgtggttgtaatgggttccggcgaaccgctggacaattatgataatcttatccgttttatccggctgctcacaggcgaaggcggacttaacatcagccagagaaatgtcactgtctccacctgcggcattgtgccgggaatccggaagctggcggaggaagatttgcagattacgctggctctttccctccatgcaccgaatgacgaagtgaggagaacgctgatgccggtcgccaaacggtacggcttaaatgaagtgatggatgcctgccgttattattttgagaagacggggcgcagactgacatttgaatacagcctggttcagggagtcaacgataacctggatgaagctaaggctttggtccgtctgattaaagaccagcacggccatgtcaatctgataccggtcaatccgataaaagagagagaatacgtccagtccggccgccaggccatagaggcgtttaaaaaccagcttgaaaaaagcggtataaatgttactgtcagaagagagatgggcagggatatagacggcgcctgcggacagctcagaaaaagttttatcgacaaggaaaggaaagagggagaatgaaagcatatgccttgacagatgtcggccgtgtccggcaaatgaaccaggattaccagtttgccagcacagaacctgtagggcctctttcaaacctgtttattgttgcagacggtatgggaggccacagggcgggagactttgcgtcccgttatctggtggaacaccttgtatcctacataaaggaatgtgacgacaccggtgcggtatcggccattaataacggaattgcaaaaatcaaccgggaattgtatgaacagtcgcttacaaatgcagaactggcaggaatgggtaccacgctggttgccgctacgatcgaggattccatactctatgtcgccaacgtcggtgacagcaggctctatcttatcgagagggagggaatcagccagattacaaaggaccactcatttgtggaagagatggtctccatggggcagatggaccgtgacagcagtgaatacagggagaagaaaaatatcatcacaagagctgtcggcataggacgaaaagtggatgttgacttttttgaagtacctttgaaaagcggcgactacattttgctgtgttccgacggcctctccaatatggttgacaactccgcaatgttccgtctcgtgcttctgccgggttcacttcagatgaaagcgaaggctttggtagccttagcgaatcagaacgggggcagggataacatagccgtgatccttgtggatccccagataagcgaggtgagtccattatgatgctgcagccgggaagttatttacaggaccgatacgagatacttgctctcatcggtacaggcggcatgtcggaggtttatcaggccaaatgccacaaattgaaccgactggtcgcaataaaagtattaaaggaggaattcagccaggattccaattttgtcagtaaatttaagatggaggcgcaggcggccgccggcctttcccatccgaatattgtcagcgtctatgacgttgtggatgaaggtgatcttcactacatcgtaatggagctgatagagggaatcactttaaaaagctatattctgaaaaaagggcatctcggggtaaaggagacaataggcattgcaattcaggtggcccagggaattgcggccgctcatgatcagcatatcgtccatcgcgacattaaaccgcagaacatgattatttcccgtgacgggaaggtgaaggttgccgatttcggtatagcgagggcggtgtcttcccagacgatcggttcgaatgccgtgggttccgttcattatatttccccggaacaggccaaaggaggatacagcgacgcccgaagcgacctgtattccctcggaatcacgatgtacgagatggtgaccgggcaggttccctttgacggggaaaatacggtgacaattgcactggcccatctggaagagccggttcttccgcccagccatttaaatcatgacgttacgcctagccttgagaggattatcctgaaagctacggcaaagaagccggacagacgataccgcgacgcatatgagcttatcgccgatctccgccatgcactggtagatccggaagatgaatatctgaagaaggaaccggagctggatgagtattcccctaccgtgatccgggacagaggggaagttgaattcgttcgagatacgcagcgcagaacaggacctcttgaccagaactggaatggcggaattgatgttcctgttgtaaaaagagaaccgaaaatggcaaagccgccgtcgggcaaaaagaaaaaagaacagcacgatgatgtaaatccacagatagagaaacttttaacaacgattgggattgtcgcggctgttattatcgttgcggtggtactcgtaatctttgcaaggctgggaggaattttcaaccttggatccggaaacactattgaaaagactacggaggcctctgcccagtcggaagagacattaaaaagtacggaatgtaaggtgccgcctcttgtcggcctgaatgttgagcaggcggagcaggcattgagcgatgcctcgctgaaaatacggtatgaatatgccaaatcggctgatgaagagaggggatacgttatcaaacagagtgtcacttcggggacaatcgtctcaaaacagtcggaaatcaccgtcacggttggggaaggcagcggcaaggtggacttgacgaagctggaattgaatacgatgacaggcgatgaggcgaaactggttctggagtcacataacctgaaggttgaattgcaggaagaaacaagcgaagagacagaaaaaggcagggttctgcgttttgaaccggagaaagcggaaccgggctccagcgtaaaagttttcgtaagctccggtccggcggttccaatggttcccatgatagacattaccggaatgtccgaggaggacgccgggacggctcttgaagccctgggactgacgcttggcgagcgcaaggaagaaaaaagcgaggatgtcgccaaaggcatgatcatcagtcaggacattgcggcccttacggatacgccgcagggtacggccgtaggatatacggtcagcacgggcaaaggaaaacagtatgtcgccgtaatcaatgacgatttcccgcttaaagatatgttcggccccagttccggagatattgagatcacggttcggattgtggcaatccagcaggtaaacggtaagcaggtggagaaggtgcttctggagccgagaaagatgggcggaaacatcacaataccgatccgctatacaataccgggagcggagggcgttttaaccggagaactgcaggtacaggatctgacgaataacaaggtactcaaatcctatccgctggaatatctggaggtagatgaataaggatgaacaagaccgatgaaaggtaagattatcaaaggcattgccgggttttattatgtccatgacggccgcagtaaaatctatgaatgtaaggcaaagggtgttttcagaaacaggaatattaaaccgctggtgggagatgacgtggagtttatggttctggacgaaaaagagggaaccggaaatatcgacgcaatcctgccgcggaaaaacaagctgatccggcctgcggtttccaatgtggatcaggctgtcgtggtgtttgccgtcacggaaccgctgccgaacctgaatcttcttgaccgcttcctggtcatgatggagaggcaggagataccggttattatctgttttaataaaatcgatttatccggcggaaaagagatcgaagagctgagggccatttacggaccggccggttatacactccattttatcagcacctatgaagccgccggccttgaaaagctgcatgagctgattgccggaaaaaccacggttctggcaggtccttccggtgtcggcaagtcgtcaatcaccaactttctgcagccggaggccaggatggaaaccggtgttgtcagtgaaaagattaaaagaggaaagcatactacgagacattcggagcttttctttgtggagaacggaacctatatgatggatacgcccggcttcagttccatgtatatcgaggatttggagccaaatgaattaaaggactattttccggaattttctgaatatgaggaggaatgccggtttttaggctgtatccacgtgggtgagaaggtatgcggagtcaagacggcagttgcggatggtaaaatcagcaggagccgctatgataattaccttcttttataccaggaattaaaagacaagaggagatactgattatgattattttagcgccttccattctgggagcagattttaaacggctcggcgagcaggtacaggaggtggacagagccggagcgccctatatccatctggatataatggacggaacttttgtccccagtatttcattcggcatgcctttgattgagagtctgagaagctgtaccaataaaacctttgatgtccatatgatggtggaggaaccgggacggtatgtagacgatatgaaaaaggcaggcgccgatctgatttgtgtgcatcaggaggcatgtacccatcttgacaggacaattaaccagattaaagaggccggactcatgacaggtgtagccttaaatccggcaacacccgtgtcgacactgtcctgtattctcgatcaggtggatatggttctcatcatgtccgtcaatcccggatttggcggacagaagtttattccctatacactcggcaagatcagggaacttcggaatttgtgcaatgaaaagggacttgccacccgtatccaggtggacggaggaatttcacctgccaatgtaagggatgtaattgaagccggagccgatgtgattgtagcgggttccgctgtgtttaaaggaaatccgactgagaatgtgaagactttcctggatatttttgaagaatatgcagcagttcgtaacagttcagacaggtctgcgcatttgctgcgctgaccgcgcgaaaatgtagtggcagcgggaatccggctcattgcgcagcgatttaattagccggatgccgtaacagttcatgctgtccgaactgttacagcagttcagtaacaggccagatgcctgagctgttacaggaataaaacaaataatcataaagagaagtgaatagcgtatgaaaaagtgtttggttgttacgggaggttctattgatatttcctttgttaaagattttttgcaaaaccggagatacgactggattgtcgcggttgacgccggcctggagatactgagtcatctgcacattgttccggatgaagtggtaggcgatttggactcggtggatcctctggttttaagagaatataaggataatccgtccgtggcttttgagatccacaaaccggaaaaagatgagacggacacggaactggctcttttaaccgctgccaaatgcggctataacagtgtggatttactgggagcgctcgggggcaggatggatcatgccataagcaatatccagctgctctatcagttttacaagcagggaatggatgtcagtatctatgatgcccagaacaggctgtatctgctgggaagcggaaaagtgttcaggaaatccgagatatatggcaggtatatttctttcatgcctctgacagaggtggtggaagggctgacgttaaagggctttaagtatcccttaaaccggcgcagaatcgtccttggaacttccctctgcatcagcaatgagctgaatggtgaggaaggtatcatggaagtagaaaagggggtccttatctgtgtggaggcgcatgactgaccgtaaactaaccggcgtcggtctgatgtacaagcacggagacggaaaaagtaatggagaatgaaaaacgcatggaagatttgaaaatgaggaacaataaagatggagctgcagcggctctacagcccaaaaagattgctgtgattaatgatattgcaggttatggccgctgtgcattgacagcggctattcctgtgatcagcgcattaaaggtacagtgctgtcctcttatcacggcagtgctgtcgaaccacgcaggatatccatcctgcttttttgacgattatacggatcgtatggtgccttacattgaagagtggaagaggctggaattttcttttgacgggatcatgaccggatttctcggttcagttcgtcaggtagagattgtcacagactttatccggcattttaagaaagaacataccaccatgctgcttgttgatcccacgctgggggataacggaactacttacagtgtctgtgacagacagctctgtgagggtatgcgcgaattgattcagtatgccgatatcatcactccgaatctgacggaggcatgtattctgaccgacacgccttatcaggaaaagggatggagtaagagaaagctctctgatttgacttataaactcctgttaatgggggctggggccgtggtcctgaccggagttgtcaagggaagtctggtcatcaatgtcatccatgaaagaggaaaagaacctgtttttcagacagcgcaccacgcagaggggaaccatcatggaacgggagatgtctttgccgcagtcatcggcgccagcgccgtaaagggcgttgcactagaagagtcggtccgcagggcggctgctttcacaagaaagtgcgttgaacgttcggaggagctgggagttccggaaattgaagggctgtgcctggaggagtgtctgccttatctgatgaaactttaatcaggcaggtgaggacgctgccgggacggccagcggacggggtggtgagatgtgtatatgagtctttcgtcccggggggaaggttgtcgtgggttggggctgcggggaagataaaatctgcggagcacgctctcgctccctgaaatgcatagcggctgctagactcgaaaatacctcgtcaagcaccgatggatttcaaaggcatccgcagattttatcttcccctccgccccaacggctcagttttcgccgggacgaaagactccgccaagtgtgtcgcccgtccgctggactgcggcggctgattgtctcacgctctaagtgtggggaaaaccttgtcgttgccacgacatgtatctgtctgcgtttatttttttagcctgtcaatgagtaaggatgctgccagtagaagtggtggcagcaacagggggcatccccgcttgacggtggagacaatcagtggcggaagggacaagagccggtgtgagcgacaaaaactgcgcctgagtcttcagtccccgtcgatcaacctggctgggggaaggaggcggaatcaattctggaggggacatgggagtccgccggtgcttagtgaggtcttttacgaacttagcaccgctgcgaactccaaagagtgcgaacggtccccgtaagaattcattccggctggattccccctctcacgacaatctcccccggggactgaagactcagacacacaacttcaccacaccggaccttgtcccttccggacgcgtcccccattctcaactaaataatagggcttttcattaggaaaaaactgtagtataatcgacaaagatatggcagtcagggaaaaaaataatataatgcttcccggaaatagatggagattgcttgaaacaacaggaggaagagatgttagatttaaagtttgtcagagaaaaccctgaaatcgtaaagcagaatataaagaataaatttcaggacagcaagcttggccttgtagatgaagtgatcgagctggatgctaagaacagagccgctaagaaagaggccgatgatctgcgcgccaataagaataaaattgcaaaacagatcggcgccctgatgggtcaggggaaaaaggacgaggcggaggagatgaagaagcaggttgccgagcagtctgcgcgtctggctgcgcttgaggagcaggagaaggagctgggagataagatcttaaaaattatgatgacgattcccaatatcatcgatccgagtgttccaattggaaaagacgacagcgagaatgttgaggttcagaaatacggcgaacccgtaattccggactttgaaatcccttatcatacagagatcatggagcgatttaacggaattgatctggacagcgccagaaaagttgccggaaacggcttctattatttgatgggagatatcgccaggctccattcggcggtgatttcctatgcaagagatttcatgattaaccggggattcacttactgtgtacctcctttcatgatccgcagcaatgtagtgacaggcgttatgagttttgccgagatggatgccatgatgtataagattgagggagaggatctctatctgattggtacaagcgagcattccatgattggtaaatttattgataccgtgatacaggaggaggagcttccaaagactcttaccagctattcaccatgtttccggaaggaaaaaggcgctcacggcatagaagaaagaggggtatacagaattcatcagttcgaaaagcaggagatgatagttgtatgcaaaccggaagacagcaagatgtggttcgacaaactctggcagaatactgtggacttattccgttctttagatgttccggtaagaacgcttgaatgctgttccggcgatttggcagatctgaaggtgaaatcagttgatgtggaggcatggtctccgagacagcagaaatattttgaggtgggaagctgctccaatcttggcgacgcccaggccagaagactgaagatccgtgtaaacggccaggacggcaaatattttgcccacacgttaaataatactgtggtagcgcctccccgtatgctgattgcttttctggagaataatcttcaggcagacggttccgtcagaatccctgagccgcttcgtccatatatgggcggaatgacagagatccgttaattaatatcaatgtcaatgatgttggggtcaaaaggtcttttgaccccgttgataccggattgctccgcactgcgtggtatcatgtcaataaagttaataacagaaataagagagaggatattaccatgcggtgatatcttctctttccgtgtgagaagactcttatgaataaacatacaatatcagtgaaacaatttattaaaaatgagaccgtattctgcgctgcggcagctcttgcggcgctgtcctgcctggccgtaaagccgggaagagagtatctgggatacattgattacagaacccttgctttgttattctgtctgatggcgctggtagcctgcatgcaggaaatcggtgtctttaccatgctggggcataggctgctgtccggcacccacgggactaaaaaactctcctttatactggtaagtctctgctttttctgcagcatgctaattacaaacgacgtggctctgattacttttgtgccgtttaccattcttgtttaccagatggtggaaaaggaagagcagctgctgaaactcgttgttttagagacaattgccgccaatctgggaagcatgggcactccgatcggaaatccacagaatctgtatctctactctgtatcaggactgtctatgaaagcattcatggagacggtattgccttatacgtttttttccatgcttctgctggggacttttttagccgttggtaagaatgagccgctatcagtgagggtgcgaatgggaaaaaggccggaggatgcgggtgtgtttatccgccgcctggccgtatatctcggactttttttcttaaatattctggtggttctgcattttctggcctggcagagcgttctggcggcggtgattttgtggatgctggcaaaagacaggaaggttttaaaggagcttgactatgttcttcttttaacctttgtctgcttttttatctttgtcggtaatatgaaacggattgatgcggttaacatccggctgatggaattaattcagggccgggagctggttaccggtattgctgccagccagattatcagcaatgtgccggccgctattctgctttcaggttttacggaccggtataagacacttctggcggccgtgaatctaggaggactgggaactctgatcgcatcccttgccagcctgatatcctacaaattttttgcaagaagctatcctggcaaaaaagggaggtatcttctggagtttacattctggaatcttgtttttttgattcctttgacgggacttgctctgtttttaacttaacacgcttcgcgatgcacagaaacacctcgcgggatactgccgtgtggacagtaacctgcggtgttactgttgcttgtacgccatacacggacggttgcattttatagaaagaaagtgtagaatataaggcagaaataagtaacaggcaatctataaaaatttggaggatgacggaatgaaatacataatcgtgcttggcgacggtatggcagatgagccaattgaggaactgggaggaaaaacacctatcgaatatgcggatactccggcaatggatcgcctggcgccgctctctgaggtaggacttgcagccacaattccggatggaatgaaacctggcagtgatacggccaatctcgcagttctgggctataatccgaaaaaatattatacggggcgttcccctctcgaagctctcagcatcggcgtcgatatgaaagcaaccgacatagcgctgcgctgcaacattgtaacactctcggaggaggatgtcccctatgaggagaggacgattcttgatcacagttccgatgagatttccacggaagacgcggccgttctgctcgatgcagtcaaagaagtctttgaaaacgagatatatcatttttatgtcggcaccagctaccgtcatttactaatctgggataacgggaaagtcgtagagttgacaccgccgcatgatgtgctgacacagaagattggaaaacaccttcccgaagatgaaatgctaaaagaaatgatgaaaaagagctttgacattctgaatcatcatccattaaatgaaaagagagcggcacaggggaaaaataaggcaaattcactctggttctggggcgcaggaacaagaccggctttatcttcattttatgacaagacagggaagaagggagccatgatctccgctgtggatctgctcaagggaatcgccgtaggcgccggcatgagaaatatcgaggttcctggcgctaacggaggactgaataccaactatgaaggcaaagcggaggccggcgtgaaagctctgttggaggagggcgctgattttgtctatattcatgtggaagctccggatgagatgggacaccagggcagtgtggagagaaaagtaaaagcgatcgaatatctggaccagagattgatccgcattgtggccggggagatggatcgttccggcgaagattaccggctgttaattatgccggatcatccgacgccaatcagctgccgtacccatgtctccgatccggttccatatctgctctatgacagcagaaagaatgcgggacaggggctgctgtacagtgaggcaaacggaaagaaatccggaatactgataaaagacggatataaaatgatcgaccggctgcttcaggactgagccggtgatatacagcacggaagataacctgcacgctgcacgaacagtttgccggcatcgacaataacctgtacatttcgcgcacaggtcaccgccttcaacgataactgcacgctccgtgcacaagtcaccgccatcaattatacaggggaggcaggaatgaaaattcctgcctcccctgtatataaaacgatattatgcacacgcttcagcaggccgctgcagccaatgccgaaatcgcgccggtgcctgtttatttcatttactaaggccattatctttgcgcacggtcagaatatcaaatcgcatggtcagaatatcaaatgtgcagctctgtctgaactgatactttactgaacttcttcaagtgttaattttggaattgccatcaatgaataatttgtatggtagattacgaatccaggtgcggaacccgccaccttcttaacggattttttctgaatataatcaatttccactttttcattgctgcggccttttgagtaataggctgccagagaaccggcctcctcgaaaaccctgtccggcagttcacgtccttccgacttcacaattacgtgagagccggggattccttttgcgtgaaaccaccagtcattaccggaagcgactttgaatgtcagctcttcattctgataattattctttccgacataaatatgaaaaccgtcggatgagatataatggaaaggccggctggtgattttgacctttttaccggaaggcccatgcttttttataaaaccgtattccgtcagctcctgcttaatctgtgccagatcttcctccttcagcgcaatatccagtgaagtgctgattgattccagatgttcgatttcctgctttgtttcctctacaaactttgaaagcgcctcataggtccgtttcagcttattatatttatcaaaaaatttctgcgaattttcacgggccgtaagctgtggatccagcgggattttaatcggttcatttgtataataattgatgcattccagttccttttccccgccgctcagctcgtatccataagtgtttaacagttctccgtaaaccttgtatttatctcttttttccgtatccttaagctgcttgagctgtaaatcatattttttatagcttctttccagagcggtctggacgattctgcggagatcggcagatttctgccggatacgtgtaataatattttttgaggaataataaagctccagcgtgctgctgatggattcataggtaactgccttatattccgggggccaggaagtaaggggaagagcggaaaattctaccggttcctcctctttgtaaagaatattcggtgaaaaaaggccgtcccgtacctgctccatcgcaagcacaagagtccggctcaagtgggtcagttccagaacggagagagacgccgccggcacatcggcatcaattgaggctagatggcagaactcctcggccattacagggctgagacccgtaaagctggtataaatcgcttttcccgagggcgcctgtgaagcggagagagtttctttaaaaacagcctcatcagaggagagcggatcttttttcccggctgcctgagggataaaatagtcccttccgggaagcacctcacggacagagctgatctgggccgaaatatgtttgatactgtcgataatcttgtcatccggtgtgcagaaaataatattgctgtgttttcccatcagctccacaatcagatatttacggcagagatcgccgagttcatcgagatgttctatttcaaaacgtatgattcgttccagtcccggctggctgaccgatacgatttttccgtttccgatatgctttctcaaaagcatgcagaagttcggcgcagtcatagggctttgtttattcgtctgagtcagatagataagaggaagactggcatttaccgacataagaagccggtaactctccctgttattctttaccgtaaaaagaagctcatctttttcggtctgagcaatttttgatatttttcctccggtcagtttgtcgttaaattcttttaccagaccggctataacaattccgtcaaaggccataattggttgttcctttctaagctagtttccatatttttcataataagctccaggcgccagagaaacagcgtcatggacagcaggtctgcacagcctcccgggcttatattgcgtttgataaaatcttcattcagccgtaccagctcattgattccctccggtgtttcagcgccgcccagcaataatacggagaaggcacactgctttacatactcaagggaagcatagtcggtcctgaacaggacattcgtatcgtccacattcgccatcagattcaaaagtatatgcagggaaaggcggttctgcagcccgccgccgcagttcgttccattctccgggcggctcagaaactccctgagagccggaagcccgaaattccgtacggcagggaaactgtcagcggcttccccgcggataccacggatcccatatttcagatagagatattccccatgggattttggattgcccggttctatttcggaaaaatcacgttccatggaagcgcggcacattttcccgcagtagaataaaatatcatcggcgctcaccgggcagcgttttttaccggaaagctcggatgcgtcgtcagacagtaaagagcaaaacagaaagcctgccgaagctgctgcaagtcccatggaaaaaataatgcctttatgggtattaacgcctcctgtcgcagcgaacatggctttttccgctttgactccggacggacggattgctttaaaaaggcatccggcagccttatccggtgaatcttcggacatcttatccccccaggaggcgcctatgccggccatctcctttataaagggcagaattgcccggatactgtcctcgaaagtcaggtaatccatatcgctgtgggctccgctgtcttttcggtccacaagccctggctttggggtggcggccacctcgtcggtgagagagagggacgcagctttttccaaaagagccagaaatcggtctgtgatcatttgtcttgtcattacttctttaacattcattctttcatcctgtcattatccggaactttactggtattccccagaagtttttcaatatgcatgaccagttcttccacgctgtggcggcggctccggctgcattcatgtgctgggcgtccgcagatgaggcaggttcggcacggcctgccggtttcctcccttgaaaccttgcatccatcctgcctgataatatcaatatcataaaggcggccgaccgaagtcccgtcctccagctccgacatcaggcgtttcaggacaagaggggaagcatcggcggaaaaaaaagcttcatatccggtcttttcacggacctcgctttcatgataaaccgtgatagccgagtcacagagcgcctgtctgatttttcggaccccctcctcaaatgtttcaggtatcttgtcaaatacctttaccggtcccggaatatttaatgtaaaactgataatcggtttgttatatgtctgaatcagggagttttgcagaaagacgcggcgttccctggcgtccagcatttcttcaagcgttacctcattattccctgccaaatccattttaacatcctcccaaatcactgtagttatttttacctgaagctgccctgactgacggacttttgcagggggacagcttctgatattctattataaagaaaaagtacggttataacaacaaatattttaatgatttaactgaggttgggaggacacgtccggaacggaccatgtccggggtggtgagggggctggctgagtgttccgtccccgtggataggttgtcgtggagggggaatccggccggaatgaattgctgcggggaccgtttgcactctttggagtgcgcatcggaatgctaagctcgaaaagacctcgctaagcaccggcggactcccatgtcccctccgcaattgattccgcctacttccccgggtcagtttttcgccggggacggaacactcaggctgaggttttcgacaccggacatggtccgttccgggcgctgattgtctccaaccttaaatggggagggtcctgtcgcggccactacatatttccggcagactgatatcaaatcttccgcaattccttaataaaggcgcattgaaggcatatcgtatttcccgtacacggtagcactgcgtgtccgcgacaaggtccgcccacacacttaacgcgtgagacattcagcggccgcaggccggcggacgggcgatacccttggccttgagtctttcgtcccggcgaaaacctgcccttggggcggaggggaagattaagtctgcggatgccgcctaaatccatcgctgattactgtgaaactttaacttctgggaagccaaaaaagcgcagacttcccccatcaacctttttgacgtttattttgaactcagctaacaggttcaggcggcaactaccggaacctcccacccaagcgcttttaacttctttaggtacgcattaatttactgtgaaactttaacttctgggaagccaaaaaagcgcagacttcccccatcaacctttttgacgtttattttgaactcagctaacaggttcaggcggcaactaccggaacctcccacccaagcgcttttaacttctttaggtacgcattaattttacgttccttgttgaattggttgtaataatcagcacccagatctttgaaaacaactccatccttgagtatgtgatagatggctataagcatggaatgggcaactgcaacataagcccgtttttttccacggtgggaactgattctcatgaactgcgcataaaagtacgaatttttatttcttgtagcggaatgcgcacagactaccagggttgaacgtaaaagagcattcccttttcgcatttttccggtcttcctcttttgggcactctcgttattgccgggacatagtcctgcccatgcagcaagatgaccggccgttggaaaacgactcatgtctgtaccaatcaccgaaataatggcctgggaactgttttttccgataccagttacatcctggattgcttgtgtcgcttttttttcttccggtttcataaagttatcaatctcatcttccagattgttgatatgaacattgagttcatccagatgggacagcagctctttcatcattcgacgttgtaatggggtcatgacaccatttaaatcatcgataagctgttccttgctggctttgagattgtgggcaatgattttctgtttatacatttcatcatactttgcttcgtcgaagaattctccggtgagaaggtattccagaatgttgcgcgcactcatgcagttgatgtcagatacagtaccggacagctttatgttggcaccctccagcatcttttggagtcggttcaattcccgggtgcgttcactcacgaggcttttccggtagcggaccagttcccttaactccctctgctgtttatccgggatataactggcttttaataatccgtgctgaagaagctccgcaatccattccgcatcctttgtatcggttttccgccccgggactgctttcatatggctggcattcaccaccatagcctttagttcagaagactcgaggatgttatacagaggcttccaataggacgctgtgctttccattgcgaccatttcacagccaccgttctgaagccagttagctaattcaagaagctctctggttgttgcaccaaagttccgtaactcctgcttgctgccttttctaaagcaggcgacgatgagctttttgtgcacgtcaataccacaacatttgtcgtaaactttatccatatggttacctccaaaataaaatttacggcacggtactctgtctattattattttactgtacgtccttctgccgcaagcggctggacagatggtggtgcaaatgagagtacctaaaatcagtttagcgaacgggctacaggcccaaattagtgccgatttttgccgttaatgtcagtataagctcaatcaacagcaatttcaatcacctgccgccctcgcagtttcatttatggtggtgccgcatcagaggcatgggggtttagcgaggtcctgtcgagcttagcagcgtgatgcatttcacagagcgggagcgtgctccgcagacttaatcttcgcccgcagccccaaaccacgacaatcacacccgggacgaaagactcatatacactccccaccaccccgtccgctggccgtaccggcggcgtcctcacctgcttaactaaatctccaataagttttttcctatgaactccataacagcattagtatttgaattataccttttaccatgttactatatttttagaaaaaatgtagaaagactctatgaatattctaaaaaaagtaacaatatacacaaataatgccttaaacaaattatgtaatacaaaaaaataacggtaattaaatggaggaggaattcttatggtaatcgaaaaagcggcagttgccggtacactggaatccagtgacgctcagattacggtagagccgggcggcggaaaggtggagcttacgattgaaagcagtgtaatccaccagtttggaaagcagatcagggcggtagtactggagaccttggagcgcctggacgtaaaggatgctaaaataaaagtagtggataaaggcgctttggattgtacccttaaagccagagtagaatgcgccgtttaccgttcagccggaataacggaaaatcttccatggggaggtgtgataaggtaatgagccatccaaacaaaaaaagactgagaagatccatgatgtttttaaactgccagaaacccggactaatcaaggatccctatatttataaaccggattccattatgcttgatttagaggacgctgttgcggaaaaccagaaagatgccgccagatattctctgtttcatgcgttaaaagaaattgactatagaggcgttgagagggttgtccgcattaacggacttgacacgccccactggaaagaggatatccgcgtctgtgtggcaggcggagctgataccatccgtattgcaaagacagagacggccgaggatgtacatacggtggaagagcatgtgctggcggccgaacgtgaattcggacgtccggagggaagcacacttttaatgtctgccctggaatcctgcaaaggcgtgctgaatgcccgggaaatctgcgtttcttccgaccgcctgatcggcatcgcattatcaggaggcgattatacaaaagatctccaaaccgtaattacagggacgggagtggaattaatgggcgcaaggcagcatatgattatggctgcgcgcgctgcaggcgtccagtgctgggataccgtatttactaatcttgatgacatggacggttttgaaaaagagacagcaatgattaagatgatgggatttgacggaaaatcccttgttaatccgcgtcagattgccgtagttcataagattttcacacccacggaaaaagagattatttttgctgaaaaggtagtgcgtgaaattgatgacaagaaagctaaaggcatcggcgtgtttacggtagatggtaaaatgattgatatcgctttctatgacggggccaaaaggaccctggctatggcaaaagccgcaggcgtttatgagggggatatgtaagatgataaataaagtgggaagagatattccggaagaaattttaaaggcgaccggcaaaaagatctttgaaggcgcctatgtctatgataattttgaatataaaaaagccgcgcctgttgtgcgtgcggtatctgatccgagacgttccaaaatggtaacgtccatcagggaggttcttgaaaaatgtgatatccgtgacggaatgaccctgtccttccatcatcatttccgtgaaggagactatgttgtaaacatggttatggaagagatccatcagatggggatcaaagacttaaccatctgtgccagctcccttggcaaggccaatgatccgattgtaccgtttattgaggatgaaacgataaccggaatccagtcctccggagtgcgcggtaaaatcggtgaggcaatatccacaggcaaacttaaaaatctggcaattatgcgttcccacggcggccgcgtacgcgccattgagacaggcgaagtccacatcgacatcgcttttatcggagcccctacctgtgacgaatatggaaactgccgtccgaacggcggtaaaagcgactgtggcgtattatcctatgccatggcagacgcccaatatgcggataaggtagtggctataaccgactgcctcgttccgttccccaatattccggccagcatatccatgacaaatgtggattatgtgtgtgtggtggatgcgatcggcaatcctgacaagattgcgacaggagccgccaaaccgactacagatgtgagaaaaatcatgatggctgattactgtacccagtttgtcatcaacacaccatacttcaaggacggcttttcgtatcagacgggtgtcggaggggcctccatcgcctctacgatttcgctcggcaaaatcatggaagagcgcggtatccagatgggtctgggactcggaggaatcacaactccgatgtgtgaacttttggaaaaaggactgatccggacgcttgtggatacacaggattttgatcagggagcaattgaatcgatcaagaaaaatccaaatcatattgaaatatccgcatccgagtatgcaaatccgttcaacaaaggcgcttatgtcaataagcttgattttgttatcctggcgtccctggaagtggacgtggactttaactgtaatgtggtcgtcggttctgacggcgttattaccggcgcacaggggggccatcccgacacggcagccggagccaaatgcacgattgtgattgctccgcttttgcaggggagaattcccgccatctgtacgaatgttacgacagtgacgacaccgggagagactgtggatgtcgtaatcactgattatggcattgccatcaatccccgccgtcaggatctgattgagtgtatgaaagacgtgaatctgccgttctgtacgatcgaagagctgcgcgacaaagcatatgcaatggtcggtgaaccggagccggtacagtttggggagcgcattgtaggaattattgaaggccgtgacggtacggttatggatgtagtgcgtgaaattaaagaatattgctttgaatagaaacgataacctgcacgctccgcgcgcaggttaccgccaataataataaagcctcatagccggattacccggatatggggctttttatttaacaggaaaatactcctgttaaataaaaaccgctccgcggaggatcgcacagcggcggtagggaattatgccgctgaagcgacccgccgctggcggagaatcccgcttgcgggattctttcgtgtttaacaggaaaatactcctgttaaataaaaaccgctccgcggaggatcacacagcggcggtagggaattatgtcgctgaagcgacccgccgctggcggagaatcccgctctgaaatggatacgcactgcgtgttaaagcggtttgcccgctaagcggccgcaatcctttgtcatatccgacggctgattttcagtaaattctatttacgggaatcagggattgcacgtgtaaaaatacaattaatgtcactttgaacaaaaatcaggcttttaggaataattgcaaaattaccatattattgattttcatgtaaaattttcgtaaaaaatccttattctataaggttttgcgaaacataagtaaaatcctatgtatgatataattgcacaattatttttcgttaaaaccaacaaaaattgtgtaattcatacaaaagctgttgaaaagctgctaaaaaaatgtataatataatcaagggctgaaggaacagtccacacagcggcaagacaattaaataaaagaaaaggagaagaggttatgaaaaaaagaacattaagtctggcattggcggcagcaatggcagtcagccttgcaggatgcggaagcagcagctccggtactgcagataaaccggctgaaactaaatcggcagaaggcgcacaggacacaggagcagaagaggcggccagtgactggaaatgggaaagaaacgttgagattatctgtccatggggtaccggcggcggagccgacaccacactccggacatttgcttccgctcttgaaaaagagcttggcgtatccgtagtcgttaacaacaaagcaggcgcaggcggagtaaccggcgtacagttcgccaccagccagccggcagacggatatacatatctgctttgcacacagtctccgatgttagcacagatttcaggagcaactgatttcgatgtatacgggaaaatcaaacctctgtgccagctcgtacacgactgcaatattttcgtgacaagttctaaatcaccatacagcaattacaatgagctgaaggaatatgcacaggctaacccgggcaaggttaaatgcggcgttatgacaatcacaggtctggatgctgcctgcgtggaagcagcatttgaaggcgatgtagaagcagtagcttatacagaaggttcccagttaaacgcagacgtaatcggaggtcatgtggatctggcctgcgtaggaccggcagaggtttccgcaatgctggaatccggcgatatgaaggttgttatgtcctgtacggaaaagaaactgacactggccggttttgagaacgttgacagtgcaggcgacctcggactggattgcttcttcggaccttcccgtggtattttctataccgaaggaacacctgaagcagctatcaaatccttcgaagcagcagcagaaaaggcagttgcaagcgaagaattccagacatgggcaaaacagcagggtctggatcagagacagggatggttaaacacagccgattatcaggcatcatgggataacgattataaagatttaactgagatgttcggaacgaaataacagatttggaacagggggagtggagcaatccgctcccctgaatgaaaaaggcagggaaaggcaggttatctgaattggacattatcttttcaatcgtattaggaattttctgcatataccttttcttcctggtaggcgccgagtcaccagctcctacagcgacagaacttggtgcagcattctggccgagaatcattctcgtccttcttatattattaataatcgtgaatatagtaaattctctcaagaagctgaagggcagtaatgagaagctcaccgcaggctttaaccttggagaatttttaaagagtaaattatttgtgggtatgattctggtggcggttatggcgattctgatgccaatcatcggttttatcccggtaagctttctgttcctgattgcttacggcgtgcttctcggtgagagaagaatcggatttctgattattgtatctcttgttattacggctatcctctacattctgttccagggcgccctggatattatgctggcaagaggaactggaatcttccgtgatttcgcgctgttctttgaaacaaaaatgccattttaaggaaggagtataaggtatgtttgatttattactgactggtttgcaaatcgtatttacgccttctacatttttccttttagtagctggtactgttttaggcgttatttttggggcaatgcctggtgtaagcgcatccatggcagttgctctggcacttccgttcgcttatgcgatgaaccccgttattgcgattgcttttcttgtttccgtatactgtgcatccatcacaggcggcggaatcacggcaattctgttccgtataccgggaacaccgtccagtgcaccgaccacatttgacggttatccgatggcccagagaggcgaagcaggcaaagcgcttggattttcactgattgcatcggctgtcggcggtcttgtagcagcatttgccatggcgctcgtatccccgcagcttgcaacggtcgctttgaagttcgggccttccgaattatttgcggtatcgttcctgggactctccgttttgtcctgtctggacagcgataatattgtaaagactctgatttccggacttttaggactccttcttgcttgtgtgggcatggatccgatgcttggtattgcacgatttacgtggggcaattccacactcctttccggtattgagatgattcctgtcatgattggtctttttgcagtcactgaagtgctgaagcagacggtgaagcctaagaaaattgacacggaaaaagatgcgaccggcagcggagccggcaagatgaagacagttcttccaagcatgaaagaggtatgggcaacaaagtttacgatgatccgttcctccgtaatcggtacggttgtaggtattcttccaggcgcaggagcgacaatcgcctctttcttatcctacgcaattgagaagaaagtttccaagcaccctgagaaactgggaaccggtatcccggacggcattgtcgcttccgaggcagccaataatgcggccacaggcggttccatggtacctctgctttccctgggtatcccgggaggcaacgcggcagcgattatgatgacggctctcgttatcaaaggcgtccaaattggccccatgcttgttaagacacagccggaatatctggcatccgtatttggctccatgcttgtaacgaatattatcatggttatcgttgcgatggcggttgcaaaggtatttgcaaagattctttccgttccatacagcattctcggccccgttatcattatgatggctgcaatcggcgcatatgcgttgaataacaatacgggcgacgttgctcttatggccggagccggcatcatcggatacatgtttgtgaaactcggttataactcagcggcgctcgtgctcggcctcgtacttggccagatgtgtgaatccaacttccgacgcgcttacacgctgaccaacggaagcctgacccagattttcacaaaaccgattactgccgttattatgatctgctgtatcgtaatgctggtttatccttttattaaacctctgtttatcaaaaataaagcagaaggcaaatagataatgcaggcgggccgaagcccggcaaagcgctgaaatagttagaaccccggctgacgtctccctctgttgcaaaacggagggaggtcagccggggttcttaatgaattacagaaatggattttccacctcgaccagtatattgatgaaatcccgcatatatttggtcagataaagattttttctgtggcagatatagcagtggcgctggctgtccgcgtagagaatgggatagatggatgccttttcaagcatctccggcgtcttttctatgtaattcttcggacagatcatgacggcatcgcaggcgatacagacctttttttccacctcaatactgacggtttccaaaataatcttcgggtgcatatcgtttgtaatgaagagattgtcctgcacagcccttacgctgtggcccggtttgttggagacaaacttttcaccgcgcgcttctgaaatcggtatcggagtgccgtttggaatccgtttagccagttccgtgtttttggaggtgagaaggacgagatcttcattttccaccagaatatacttcagctctgtatggcgcgcggttgtggtcatgcaggccatgtccacggttccgtccagcaccatgttctccatcagcccggaaccctgttcaaatacctccacatccacataggggtacattttaaaaaactttggaagtacatagggaagcacctgcatgcctctctgtacgggaacgccaaagcgcagttttccatgatcctcctgggtaatctcttcgatttccttggcgaggtttgtattgatggtcaggatctgctgtgctgcttccatatatttttcgcctgcgtaagtcagtgtaagcggttctgtagatcggttaaaaatcggagttcccagattggtttccaccagtttaatcatctggctcagggaaggctgcgatacatataatttttttgccgcgctggtgatactgccttcctgcaggacggtcagcatatactgggcatgcttaagattcatattttattcccccgttagtttctggtagtgtcaagtctgacactccgttttttattaaaaaccttgtattttcagggattacaccacttttgaaaataaaaaagcaatgacctccccttttctggtataatgagttcaccacaaaccatcacctaaaaaggataaatcattgcttatggataacattatactctatttactcactataattcaagaacaatacaaaactatctgctggctcctgaactttatctgcaaatatattccactcaagcagtgggcctttgatggttcccactcccctaaataccagaagtttactaccgaccccctcccgctcctcaagccgttcatcaaacaggactggcagtttctccttgaatactatctctggaagtacggcaaatccgtcagacccgttcagcgccgcaatggtaaatccatccctgaagataccttctgtcctctttgtggggcacctcaccactatctctacgataataatggcggcaatgggcagttccaatgcaaagtctgtgggcagacctttgtcaccggcgaggttgtcacatcgcctctccgctttgtatgcccttactgcggccactccctcgtccctaataaggaccggaagtttttccgcatccataaatgcgtcaaccccaggtgctccttctaccttcacaacctctccagggttgataaggaccatctgcatgaggattacggtaaaaacaagtataagctgcactacctctaccgggaattcacggtggatttcttccgcatggacttagactccctgcctgagaattcctcctccctgaagttttccaaacataacgctcatatcatgtccctgtgcctcaccatgcatgtgaacctccagctttccctccgtaaaacggctcaggctctgtatgacctttacggaatcaggatctcacatcagcaggtcgccaactatgccagaacggccgccattgtcattaaaccctttgttgaccactatgaatatccaaagtcctccgtctttacggcagatgagacttatatcaaagtccggggcatcaaaggctacatctggttcatcatggatgccgcttcccgctccatcctcggctaccaggtttcagacaaccgctctgtcgggccatgcatcctcgccatgcgcatggctttccggggcataaaaagactccccgagaagtttcggttcattgccgacggctatagtgcttatcctctggccgcccagcagttcgtaagggagttgggagacagcttccagtttgacattacccaggtaatcggactcacaaacaatgatgcggtctctaaggagttccgcccctacaagcagatgatcgaacggcttaaccgcacgtttaaatccacttaccgggtcagctgcggttacgacaattacaatggcgccaactataacgtggcgctctgggtcgcctactacaactttctccgtccccataagcacaaccactatcgggtgctcaatccagtcggtatgctggagggggctgacaacatgcccgggaagtggcagctcctgattctgctcggtcagcagaccatcctccagctgaaggaacagcaggctgccggttaaatctgttcttagattccgggccagaggtaaaaatgcagccatcccgaagggacctgcccttgatggcacgccaaaacaatgctatcatgctgtgacgcagacggtgaaatcttatctgttcctgagttcttcgccgtcggtaagacgttcagagcattgttttggtgtgccgtcaagggtggcggacactgccagtttctaaatatatctgtaatttacaaggttcatttacgccgggttccccggccatcggttttcataaatcacttgacactacctagtttcttagagcgttacattccgatcatatcatttctgggtgaaaatagcaatgcgtatggatatttagttaagcaggtgaggacgccgccggtacggccggcggacggggtggtgggattgttttatgagtctttcgtcccgggggtttggcatcgctggatggagaaggagatactgtggttttgttttcgcagggcggagccggagagaataatatccggctggactgcttcttcgagggatagctctaagacagaggaaggcaaagccctccggggttacggacaaattcgctccgaactccgaatgagttcgaagctcaagttgtcccggattttgcccttgtagggctaaaatccgcccggcgcgctttgtctccctctgcctaagagctatcatctctcgggcgaacgtccttccggatatcattctctccttctccgccggaagatgtcggcagtatctccttctcccggaaggttttcgccgggacgaaagactccgccaagtgtatcggccccgtccactggcctgcggccgctgaatgtctcacgcgttaagtgcggggggcggaccttgtcgaggccactcagtgctaccatgtacgggaaatacgatatgccatcaatggactttaaaaaaaattgcggaagattttgatattggcctgccgtaaacacgcagtggccgcgacagggccctccccatttaaggttggagacaatcagcgcccggagcggaccatgtccggtgtgcggaaacttccgcctgagtcttccgtccccggcgaaaacctgacccggggaagtaggcggaatcaattgcggaggggacatgggagtccgccggtgcttagcgaggtccctcacgagcttagcactgctgcgcactccaaagagtgcaaacggtccccgcagcaattcattccggccggattccccctccacgaccaattcccacggggacggaagactcagacagattcccccactacaccggacatggtccgttccggacgcgtcctccaacctcagttaaatctccatttaaattttgacacgcatttgcagctaatgtataattattacaattcgaccggaaggcattctcaggaaacagagaggtcaacagtttcctgaaaccatataaaaagggggtttgcggtttgaaagaacaatatagaaaactaattgtactctattgtacaatgtttaaaataggttgttttacatttgggggaggatggagtatcatcgcccagattgaagaagagttctgcaagaaaagggggtgggtgacggaggaacagattctggattttatgtccgtggccaaatccctgccgggtatcatgattgtcaattactccgtattattcggctatacggctgccgggatccccggcgcgctggcggcttcttttggactcgtatccccggcggtaattgtcattgcggtaatcacaaatttttacgacatattctgtaataatccttatgtgatccggatgatgaacggagttcgaagcgctgtgattcccgttattatcggagctgcctggaagctgaagaagaatgcgctgactgacagggcaacgtatctgatcgggattgcagtcaccgtcatctgtgtggtttctgatttaaataagctggctatcgtggtcctctgcggcctgattggcatagcaatatacgtaaaggagaggacaggccgtggcagagatctatcttaaactcgtatttgcatttatccgaatcggcttttgcagcttcggaggactgacaatgattcccgtaatcctggatgaagtgacggccaatggctggatgaccgaggcccaggtgatggatgtgatggccctggccgagattacgcccggctcaatgggaatcaactgcgctacctttgtcggataccggatcgacggaatcccctgtgcgctgctcagcagcctcggcgttatggttccgtcactgacactgtgcatgctggccgcccatttcttaaaacggctgaaagggaatccttggatggaacatgcgctgtgggggatccgcccggcctgtgtcggtatgctggccgcagtggtgataacactgagcggctccacttttctaagcggggaatttatcatacggtggaacctggtcatcattgcgctgattacgggaggggcaatgtacaagttccgtctttcggttccgaagacaatgctgctggcagcggttttggggctgattgccggatagagacacggcataattctgtaacagttcagactgtctgcgcatttgctgcgctgaccgtgcgaaaaggcagtggcagcgagcatccggctcatcgcgcagcgatttaattagccggatgccgtaacagttcatgctgtctgaactgttacgtaattttgaaattagttgactcccctctctatttgcattataataccattatctatggacgaaagagggaactgtgatgttaaagagtatgaccggttttggccgctgcgaaattacgacggaggaatacaagatttcagtggaaatgaaagcggtgaaccaccgttatctggatctgagtattaagatgccaaaaaagttcaatttctttgaagcaggtatcagaaacctgctgaagaagtatatccagcgaggcaaggtggatctgtttatttcctatgaggattacaccgaaggccggatgtctttaaaatacaacgcttctctggcggcagaatatatggagtatttccacaggatgtcggaacagttcgcgattgagaatgacgtgcgcgtgtcggctttggccagattcccggaggttcttacgatggaacaggagccggaggatgaagaccagatgtggaagattctggaggaggctgtgagcgaggccgctgccaggttcgtagagagcagaattaaggaaggtgagaacctgaaaaccgaccttcttggcaagctggattatatgaccggtctggtggatgaaattgagaaccgtacgccggggatcatggatgaatacagaagaaagctggaagataaggtgaaagaacttctggagggttctgccgttgatgagggcaggatcgcaacggaggttacgatttttgccgacaagatctgtacggatgaagagacggtacgtctcagaagccatattgaagccacaaaggcggaactgaccgccggaggcagcgtgggaagaaaactggattttattgcccaggagatgaaccgcgaggccaacaccattctctccaaagccaatgatctggaagtgtctgataaggcaattgcgctgaagacagagatcgagaaggtcagggagcagattcagaatatagaatagcagccagcagcttttactgccgttcagataagattaacagacaaacggagacttgaatgatgaataatcagggagttttagtagtagtatccggattctcaggcgcaggcaagggaacgcttatgaaggcccttctgacaaaatatgataactatgccctgtccatttccgcgacaacccgtaatccgcgggaaggagaagaggacggaagagaatacttttttaaaacacgtgaagaatttgaacagatgatagagaacgacgagctggtggagtatgcccagtatgtcgggaattattatggaacgccgaaggtgtatgtcacctccggcatggaagctggaaaagacgttctgctggagatcgagattcagggagcgcttaaaattaagcagaaattcccggaagcggtgcttatattcgtaactccgcccagcgcagaggagcttcgccgccgtctcgtaaaaagagggacagagccggttgagacgatcaatgcaaggctctcaagagctgccaaagaggcagaaggaattgaagattatgattttctccttgtaaacgacgagattgacgaatgcgtcgacaggatgcacggcctgatacaggcaatgcatgcaagggtagggaatcatttaaacttaatcagaacaatcagagaagaaatgaaggacttttgaaaggagcctgaataattatgatgttacgtccatcctataatgatttaattaaagtggtgaacagcggtgtggagcctggtgatgagcctctgatacagagccgttattcaatcgtgattgcgacagcaaaacgcgcaagacagctgatcgcgggggaggagtccgccgtaccggccgatgccagaaaaccgctttcaatcgctatcgacgagctgtaccaatccaaagttaagattatcaacgacgataatactcctgaagatgagatcgaatactaatgaagaaggccgtctcgcgctttttaagtgcaaggagatggcttttgttgattggcggtgacctgtgcgcggagcgtgcaggttatcgctgattggcggtgatttgtgcgcggaacgcgcaggttaccgctgaatgtacaaaaaattgattggagtgaaagaatgaaaatactttgtatttccctgggctgtgacaagaacctggtggatacggagatgatgcttggacttttaaataaggacggccatacatttaccgacgatgagaatgaagcagatataattctgattaatacatgctgctttataaatgatgcgaaagaggagagcgtgaatacaatcctcgagatggcggagtacaaaaaatcaggaaagtgccgggcgctgatcgtcaccggctgtatggcgcagcgctataaggaagagatcatcaaagagataccggaggtggatggaattttgggtacctccacctatgatgagatatcgaatgtactgaacaaagcgctttcaggggagcaggcagtctgtttccatgctctttcagcccttcctgaggtcagcgaaaagcggattgtcacgacggggggccattatgcgttcctgaaaatatcagagggctgtaataagcgctgtacttactgtattattccgtctctccgcggcccttaccgcagcgtgccgatggaacgtcttctgacggaagcgggacagctcgccggacagggcgtgaaggaattgatactggtggcgcaggagactacgctatacggaacggacctttacggtaaaaagatgcttcctgagctgctaagacggctggcagagataccgggcattgaatggctccgtgttcagtactgttatccggaggagattacggaggaactggttcaggtaatcaaagaggaggaaaaggtctgccattatctcgatattccgattcagcatgccagtgaccgtatcttaaaaagcatgggaaggaagaccagccgggaggagcttaaggagcggatagcccgtctcagggaggagatacccgatatcgttctgcgcaccaccctgatttccggttttcccggcgagacgccgcaggatcatgaggaactgatggaatttgtggacgagatggaattcgaccggctgggcgtatttgcctattcggctgaggaggatactccggcagcctcatttccggatcaggttccggaagaagtcagagccgagcgacgggatgaactcatggaactccagcaggatatagcctttgaaaaggcggagagcatggttggcaggattctggaagtcatgattgaaggaaaagtggcggatgagaatgcctttgttggaagaacttatatggatgcccctggtgtggacggattaatctttgtaaatgcagacgttcccctcatgtccggcgatttttgccgggtcagggtgacaggtgcggctgactacgatttgattggagagatgatagatgaatttgccgaataaactgacgacactgcgcgtctttatgattcctttttttgtgttttttctactttatcagggaggagaaaatacgaccttccgcatgatttcactcgttcttttcatcgtggcaagccttaccgatctgctggatggaaagattgcaagaaagtataatctggttacaaattttggaaagttcatggatcctctggccgataagcttctggtctgttccgccctgatctgcctgagcgagcttggacagcttccggcctggatggtcatcatcatcatcagccgtgaatttatcatcagcggtttcaggctggtggcttcggataacggggtcgtgatagcggccagctactgggggaaattcaagacaacatttcagatggtggcggtagtccttctgattctgaatttgccgtcccttgccctcatcacaagcttctgtgtctgggtagcgctcgcattgacaattatatcactggtagattatattgctaagaactataagattcttacagaagggagcatctaaagatggttgttgaactgatttccgtggggacggaactgctgcttggtaatatcgttaatacaaatgcccgttacctctctgaaaaatgcgccatgctgggtttgtcggtatattatcagacgacggtaggcgacaacagggagagaatggctagtgtcataaagactgcgcttgacagggcagacatgattatcctaaacgggggacttggccctaccgaggatgatatcacaaaagaggtctgtgcagaggtaatgggggcccgcctggtggaagaccctacggtaaaagcccatcttgaagaatggtacaaactgaggatgaaaagcgaactgccggaaagcaattggggacaggccctggttccggaaggagctgttatttttgaaaaccacaatggcacggctccgggtcttgcagtggagaaagacggaaaaattgcaatcctgcttccaggccctccgggcgaaatgtatcccatgtttgaagagcaggtctgcccttatattcagggaaaacagtccggtatcatccgatcccagatgataaagatctgcggatttggtgaaagcaaggtggaggagatgcttctcgatctgatcgacagccagaccaatccaacgattgccacctatgcaaagacgaaagaagttcatatccgtgtcacggccagagcggagactgatgaggaagcgaagaagattttaaaacccgttgtaaaagagattaaaaaacgtttcggcaacgcagtttatactaccgatgaaaacgagacgctggaagatgttgtagtccggctgctcacaaaatacgacctgactgtcacgacggcggaatcctgcaccggaggactgctggcagggcggctggtcaatgtaccgggcgcttccgaggtattccgccagggcttcatcacctattccaataaagcgaagaggaaacagcttgacgtcagcaaaaccacactcagaaaatacggtgcggtcagtgaacagacggcaaaagagatggcaaccggcggggtttttgcaacggatgccgatatctgcattgcggttacgggcgtggcggggccggacggcggaactccggaaaaaccggtaggcttagtctatattgcatgctatatgaaggacagcgtacaggttgaggaatatcattttaacggcaacagggaaaaagtccgtgaacagacggttgtacaggcacttgacctgctcaggcgttccgtgctgagccattataaaaaggattaaaacggtagtaaaagtagggctttataagtgccaataaggagaaagactgaggggaatagaagttgggtagtgttgataaaaaaaagctgctttcggcagcacattattattcctacacaagatttacactgaatctgttcagcttgtttgaggatatggaggaagcggttccctccgcatttctgagggagtttgcggtcaggctgaccgataaagcagagaattttctcaaaggggaagaggaatgctccgcgctggaagagatgagagagcaggcgctgggcctgcttgaccgtgtctcaaattatctggactgttactgtatacacgaatatgtgatggatcgggtggaaagaaagctcttcccggaggaatccgtccgtatcgttcccgaggctctggcagactctctgatggatttcatcatggatggtgaaaacaatctggataccaacaggcgcattcagacgattgtcggcgagctgcccgtccgctttactaaaagtaaattttacagcgtaatcgaggaaagcctgaggccatacaaagggcgcgaaaaaagagatttggaacggatgattgacaagatacgcagtgcggccgcattgccgctctatgaaacaaagccggaggatgaactatcgcagatgctttttcagaacattcacagtacagccgtggagatggaaaaatgcgattatccggagcttacccgggacagctttcaagcgctcaaagaacgctttaatcaaagctatgacagcttatccaatattctgggccagttaatatgccttccggatttggtcaatgatttatatgtgctggaaaaaagccgggcttatgttatagattctccttacctggatacggcggaaaagactctggacgccgttcttaaaagaatcatcggtggagatgattactgcgcagaggacggcggtgagatttccgcgctgtttgccccgctggaaggaaaacaggagtattactgggagcagtatctgaaggagcttggcaaatgcgcttcgccggaagaggacacggatgaggaactgttcacagtggaccggttattatccggaagcttcgccgcttcccttaagagggagccggacggcggcaaggtaacggaacaggtgttttcctcttccctggagactttattcacacaactggaaacgcgtttaaaaagaacgtgtaaagtcacatccagagcggtaatggcaaaggttctgtccgaaataccggtttggtttaattcacttgaggagatagagtcttatataaaggacagtcttgcactgtgcatggatacggcggaaaaagaagcctgcatgataaatttgaagcagataatggtggaggggaatgcgctggtataagcatctatatgtaggccaaaaagccaaaaagaaaagatttacaatcatacagaatatccgtaaaggcaggtttcaggcgggagtccatgtgataaccccggcttcatgcggggagaacctcatggatatttatccggccagcctcctccttacggaatattacagtaagaaagaggatttactgattctcggaattgctgccgattactatgaagcgctggaagtggcgcgtgacattgtagatgagatgtatcatacgacaggcaggttttccattcgggaatttctctctaataatgggcagaggtgaatggaatgctccatattttatttctaatattgaaaatagcgggattcctgctgcttgccatactggggcttatcattctgcttcttctgtctgtccttctggtccctgtcaggtaccgcggacagggatctttttatgaaaaaccggaaggtgtgttcaggataacatggcttctgcatctcttttcggttcgtgtaagttactatggagaacccgagatacagatatgtatcctcggattccgtgcttttaaagatagaggagaagaggcggaagaattcgatgacggtgagccggttcctgacgaagatgcgttttccgtcaggggagcgcatgcggatgaagaggcatatcacggtgttttgcaggacgagccggttctttctgcgcaggagataaagcgggatgaaccggaagatccgaaactgcagttttcacggcatgaggaagagagtgagcctgagaagcaggcagacatcccggtgaaggaacatctgctgcagcgtctggccgggaaagttaagagatttttccgccggctggcgcttgctttcagaaacatttgcgatgctctgaaaaatgcggataatctgagagagtctgccgcttcgtttatgcgggatgaagagaatcaaaagacgtataggctgataaaaaaacagctaaaaaaagtattgcgacatgttttgccggtaaaactaaaggggactgtcacatttgggtttgaggaaccgtatattaccggccagatccttacctgggctgcgcttctctatccgctgtatcacgataagctcattatccggcctgtatttgacaggcaggtgctggaaggcgaagtgtcactgaaaggacgcatccggacgggcactctgctgatggccgggatccgtgtattgttaaataaaaatttcaggaaacagctgaagcggttcctgaaccgaggaggaatataatatggcagataatcagttttcatcaacagtggaggcactgtttaaaggcatggataattttgtgacaaccaaaaccgtggtgggagaggccgttaagatcgacgatacgattatccttccgctggtggacgtaacctgcgcaatggcggccggagccttcagccagccgtccaagaataacggtgcaggcggtatgagcgcaaagatgagccccagtgcgattctcgtcattcagaatggcgtcacaaagttagtcaatatcaagcatcaggatgccgtcacaaaaatcatcgatatggttcctgactttgtcaaccgatttgtaggcggaaaggacgacgtgattacggaggaagctctggaaaaagcagaggcgatggcggaagaattagaaaaatagccgcatgattttaccctggccggcatataatactggtaaccggatttgtacagggaggggactgccgtgaggcgtctatgcgggcttgtaatattttccataggcattggaatgatgctggtactcatttttcccaagaacttcctgtgggtctgtgcagccatttcatgcctgataatcggatataatttgttctgcggctgttaaagcccggaagaatgtcaatacagagacgctaacctgtacgcggagcatgcaggttagcgtcttcaattaagaaagaatcgcgctcgcgggattctccgcctgcggcgggtcgcttcggcgagtgtaacgagcttagtgaacaagccttctttagagttgcgatcctccgcggagcggtttttatttaacaggagagatttcctgttaaataaaagacagccccgggcaaatgccaggggcttcactgttcaacggttaaaatttgcagaacttacaattccttgtgtctatcacaattaagctctttcaactaagccggatcttaagcaagaagtacatacgtacatcttctgagctccgccgttagtttttaccttaacagacttaacgttagctttccacatcttgttagatcttctatgtgagtggcttactgcattaccgaagtgagcagctttttcacagattgcacatttagccattattgcacctccttaaccgaacgaattggacttcctattaaaaatccataacaaatgtataatagcagaaagaagggaattttgcaagtgaaatttaaaaatttgtttcttttttcatgaaaataaggtataataatcgcagagcgattgttataattcagttcccggcagggatatgagataatcatcaatataaatagaaagaaacggaggctgtgagatatgaaaggtcgcattaataataaatttggttcgatacagatcgacccggaagtaatcgccatgtatgccggcacgactgccgttgaatgctttggaattgtcggaatggctgcggtcagtatgaaggacgggctggtaaagctgcttaagagggacagtcttacccatgggattaacgtttccatcaaagaaaatatgatcagtattgacttccatgtcattgtcagctatggtgtaagtatttccacggtcgcagacaatctgatagagaatgtaaaatataaggttgaagagtttaccggaatggcggttgaaaaaatcaacatctttgttgaaggcgtaagagtgatagattaaggaggaaactacctgtgggtatgaactatattgacgccgagatgcttaaaaaagcatttctggccggagcgaaaggccttgaggccaataaagaatggattaatgagctgaatgtatttcccgtaccggacggcgatacgggaaccaatatgacgatgacgatactttcagcggccagagaggttgcggcaatcgaaaatccgacaatggaatctctcgccaaggcgatttcatccggttctttaagaggagccagaggtaactcaggtgtgattctttcccagttgttccgcggctttacgaaagagataaagacggtggacgttatcacgacaacgactcttgccaatgcgtttaaccggggaacggagactgcgtacaaagctgttatgaaaccgaaggagggtacgatccttacggttgccaagggaatggccgataaagcatcggagcttgtctcacagacagaggacatcatcgaatttgcacgaaaggtaatcgagcacggcgattatgttctgagccagacaccggagatgctgccgattctcaaagaagcaggcgtagtggattccggcggccagggactgatgcaggtcttaaaaggctgtctggacgggctgaccggaaaggaaatggatctgtcggtggaaggcgccaggacacaggcaccgcttcagactgcaccgcctgccgaagaatttgacattaagtttggctactgcaccgaatttatcataaatctggaaaaagaatataaccagaagtcggaacatgaattcaaaggatacctggaatcgatcggtgattccattgtcgttgtatctgatgatgatatggtcaaagtacatgttcatacgaatgatccgggactggctatccagaaggctcttacctttggttcgctctccaggatgaagatcgacaatatgagggaggaacatcaggagagactgattaaggatgccgaaaagctggcgaagcagcagaaagaaaaagaggccatggagccaaggaaggcatacggatttattgcagtctccatcggagatgggatgagcgaaattttcaggggaatcggtgcggactacctgattgagggcggacagacgatgaacccaagcactgaggacatgctgaatgctatcgactgcgttaatgccgatactatctatatccttccgaataataagaatatcattctggccgcagagcaggcaagaagcctcgtaaaagataaaaagattattgtggttccatccaagacggtgccgcagggaattacggcaattattaattttgcaccggatctgccgtgggaagagaatctggagctgatgatccaggagatgggtcgtgtaaagagcgggcagattacctatgcagtcaggaacacctccatcgacgggatggagataaccgaaggagatatcatgggaatcggtgacagcggcatgctggctgtcggtaaggatgtggaatcgacggcgcttaaaacactccgggccatggtagatgatgaatccgaactgatttccatctactatggagaagatgtgaaggagagcgaggccgaagcgttctatgaaaaagcacaggaggcattttccggctgtgagatcgagcttcataacggcggacagccgatctactactatatgatttcggtggaataggaatatccgttacacagaggcagaccaaagaaaaaagcggcggtttgcctctgcttttttctttgcagaagtttataaattgtaaaaggttaaattgatgaaaaatgagaattttaaaaacatagtgccgggtatcgctgaaaggcctgttacatcgctgaaaggaatcggtgacaagacggccgggctgttcgccaggctgggggtgcagactgtggaagatttgctccattactatccccgggcctacgataccttccgtgagccgcagccgatctcagagcttctcccggagacaatggccgccgtatccggtatgctgaccaagacggcggacgttgtaaaattcggccatctccaggtgaccaccgtgactgtccgcgacatcagcggaattctgacgctgacatggtataatatgccgtatctgagggggaccctgaaggcgggggagcatttcattttccggggacggcttgtcagaaaaaggggacggctgacgatggagcagccggagatttaccggccggaagcctatgcgcgtctggtgcactccatgcagccggtttacggccagacaaagggcctgggaaacaaaacaattgccaggacagtggcggaagccctcgaggttaaggagacggagaaagattacctccccgccgccctgagggaaaaataccagcttgccgaatataattttgctttggaacatattcactttccgaaggatgagacggagcttcttttttcaaggaaaagactggtattcgacgaatttttcatgtttctgctttccgtacggcttctgaaggataagaaagtggacaaggcgagtccctgtccgttcaaaattgataatcagatccgcgggctggaacagaggcttccgtattccctgaccaatgcgcagaaaaaagttctggatgaggtataccgcgatctgtcggggggccatatcatgaaccgcctgattcagggggatgtaggttccggcaaaacaattattgcagtcctggcccttctccaggcggccggaaacggctaccagggcgctttaatggttccgacggaggttttggccagacagcattttgaatcgatgaatgagctgtttacgggccttgggctgtctgccagacctgtccttctgaccggttccatgacagccaaagaaaagaggctggcctacgaaaggattgcaaaccatgaggcagacattattgtagggacacatgccctgatacaggagaaagtgatctatgacaagctggccctggtcattaccgacgaacagcaccgttttggcgtgggtcagagggagatgcttggtaataaaggaatggagccgcatattctggtcatgagcgccacgccgattccgcgtaccctggccatcattatttatggagatttagatatttccgttatagacgagcttcccgccaaccgacagccgattaagaattgtgtcgtgggcagggattaccgcgaaaatgcctaccgttttatagaaaaagaggtaaaggagggacggcaggcctatgtcatctgtccgatggtggaggcgagcgagatgctggaggcggagaatgtcgtcgattacacgaaaaccctcagggaacacctgtccggtgatatacgggtcgaatatctgcacggaaagatgaaggcgaaagaaaagaacaggctcatggagctttttgccgccaatgaaatccaggtccttgtctccactacggtcattgaagtcggaattaacgtgccgaatgcaacggtcatgatgatagaaaattcggagcgtttcggacttgcccagcttcaccagctccgcggccgtgtgggccgtggaaaggcccaatcctactgtattatggtaaactgctccggtgaggaggacgcgcagaagcggcttgagattttaaataaatcaaatgacggctttttcattgcttccgaagatttaaagctcagagggccgggcgatttattcggcgtacgccagagcggcgatctggaattcaggctggccgatatttttacagatgccgatattctgaagacggtttccgaggaggtaaaaatgctgatggatcaagatccccttctgtcgagcggagagaaccgggaattgaagagaaagctggatgtctatctggagagaagctatgaaaaactgaatttgtaagtaaaggaggatattatgctacggctgagaccctataaaccggcagatgccggatatctgatgaaatggcttgaagatgagcgcaccgtggaattctggaaggcagaccggttttgctggccgctgacggcggagcagcttgccgattactgcgaagactttacagcggatccggctgccgctgccttcaccgcactggacggcgccggaaatccggccggccacttttcctttcggcagatcgactgggccgggaaccgggcccacatgggctttattatcgtagatcccggctgcagagggaagggctatggaagggagatggtccggctggcgctgcagtatgcccggctgtgccttggccttgactttgtcactctgggcgtgtatgactgcaatgagccggcgcgccgtttatatgaggcggagggatttgtaagagcagaccggctgggagaaaaacagaccggctttcgcggtgaaacatggacctattattacatggaagccgatctgaggagcacataaagcagaaggctccgttacagtaacagttcatgctgtctgaactgttacccgttacatgtgaaatatgactgcttccgattcaggaactgtctggacctggaatgggttccggcagttccttttctgttgaaggcggtgacccgtgcgcgtagcatgcaggctatcgttattccttattttgttgtttttcattgccagaacctatatcttgtggtatattattacagtagacaactaataacagttattaatactgatatatagctgtctttgattcttcccccggataactgcttatccggttgggagaataatttcattgatacttcaaaaaataagcgtaagagtccacagggggtaaataatggataatctaaaagataccggcgccggcaaaacagccggatcgcaggtgagcctgcagagcctggagcatttaacccgggagattccggagctggcacctgccctggaggaaatagaggcgaggtggccgaaggaggaatattccccggagcttctggctcataagttttctgcttttgtaaaaaagaatatggaaccggaggaagcgttatccctgctgattcaggcagcggcagaactgacgcgaaaggaagcgccggactgggagtatattgccgcgtaccttctcctggtgcgttttcggataaacctgagggaagaggataagaagcacgggatcggcagcttctatgacaggatccgctatctgacccgggaaaatctttacggcagctatattatggaatattacagcagagaagagctagaggaagcgggcggcctgatcgacgagaagcgggatctgcttttcaattatgcaggccttgatcttctattatccagatatgtaatacggagccgccaaaacataccgcttgaatcgcctcaggagatgtttctggggatttcgctccacctggcgatgaaggaacaaaaagaccgtatgaaatgggttaaacggttctacgatatgctgagtacgctgaaggtcacgatggctaccccgacgctttccaatgcgcgaaaaccttaccatcagctttcatcctgcttcatcgatacggtgccggacagccttgacgggatttaccgcagtatagacagctttgccaaagtcagcaaattcggtggcggtatgggactctatttcggcaaggtgcgggcatccggcagttcgatccgcggtttcaaaggagcggccggaggcgtaatacgatggattaagctggccaatgacacggcagtggcagtagatcagctcggcgtgcgacagggggccgtagccgtttatctggacgtatggcataaagatcttcccgaatttctggcgctgcggaccaataacggcgatgaccgtatgaaggcacacgacgtttttccggccgtatgttatcccgacctgttctggagactggcagacgaggcaatcgattccgactggtacctgatgtgccctcatgagattctggcggcgaccggttatgccctggaagattattacggacaggaatgggaaaaacgttattgggactgtgtgaaggatgagcggatcccgaaacgggtgctgccaatcaaagatatcatccggctgattttaaaaagcgcagtggagaccggaacaccgtttaccttcaaccgggatacggttaaccgggccaacccgaaccgtcaccgcggtatgatttactgcagtaatctgtgtacggagattgcacagaatatgagtccggtggaagctctggagcagaggattgagacggtggatggagaaaccgtcgttgtgactgtgacaaagccgggagattttgtggtatgcaatctggcaagcctttccctggggaaaattaatgtgtcggaccgcagtgaactcacttttcttgtacgctgtgcggtccgggcgctcgataatgtgattgatctgaatttttttccggtgccttatgcgaaaattaacaatctgcggtaccggcctgtcggtcttggcgtcagcggttatcatcatatgctggcgaaaaacggtatttcctgggaatcggaggaacatctggccattgcagatcgtgtgtttgagtggatcaactatgccgcaattgaggcaagctgcgattatgctgaggaaaaaggctgctacgaatactttccgggaagcggctggcagaccggcagttactttgaaatgcgtggatattgttcggatgagtggcgccgtctgagagaaaaggcagccgccgtgggactccggaacggctggctgattgccgcggctcccaccagcagtaccagcatgatttcaggcacgacggccgggctggatccgattatgaaccgcttctatctggaagaaaaaaagaacggcctcgttccgcgcgttgcgccggagcttacgccgtcttcttactggcggtataaaaatgcccattatatagaccagaaatggtccctgagagcagcgggtatccgccagcgccacattgatcaggcgcagagtatcaatctttatattaccaacaattatacgctgcggcaggtgctggagctctatcttctggcatggaaaagcggggtgaagaccatttattatatacgttcaaaaagcctggagattgaagagtgtgaagtctgttccagctagaacgtttctgacgggcagtaacggaagcgggatatacaggcagcggaacagaacacagtaataggagagaggtaaattcaaattggaagaactgaaacgcaaattgttatttaatccggacggggacaccgatctgcaaagccgccgtatgattaacggcaataccaccaacctgaatgattttaacaacatgaaatatacctgggtcagcggctggtaccggcaggccatgaacaatttctgggtgccggaggagataaaccttggaactgatgtaaaggattatccgctgctgactgtgggggagcggcgggcctacgacaaaatattgtccttcctcgtctttctggacagcatacagacggccaatctgccggccatcggcgagtatatcacagccaatgaaatcaacctgtgcctgtctatccagatatttcaggaagcggttcacagccagagctacagctatatgttagatacaatctgtgaaccgcagaccaggaacgaggttctgtaccagtggaaaaatgacggacacctactggccagaaataccttcatcggaggcctgtacaatgaattccagaaggataagactccctttgcctttgtgaagactttgatagccaactatatactggaagggatttatttttacagcggttttatgtttttttacaatctcggacggaaccacaaaatgcccggctccgcccaggagatccgctatatcaaccgggatgaaaatactcatctttggctgttcggaagtattatccgggaactgcagacagaagagccgtcgcttttttcccgggagaagacagattgttaccgtgagatgatacgggaaggctgcgagcaggagatagcctggggctgctatgccatcggcgatgaagtgcccggacttacaaaacagatgattacggattatatccgctatctgggaaacctgcgctgctctaatctgggatttgagcctctctatgacggatatgcgcatgagcctgaaacgatggcctgggtcagccagtacagcaatgcaaacatgatcaagaccgacttttttgaggccagaagcacggcatatgcaaaaagcagcgctttggtggacgatctgtagtactcatgtacgagcgcaccgaagcgatggagaaaccggcagaccgatatgcagaaagccggagtccgtacataccaaatcggtatggaacgaactccggctttctgccgccccggcttatactaatgttttaaaatactgaaacccgtccgcattctcattatacctgcggatcagcttctgaatcttcgcagtcggagtcagtgcattctcaagcgatacgttgtggttcagggagttgataatagcggcaatgaacttgctcatatcggcttccacataccattcacgctctaaaagctctttcgtgcggtaattcaggtttgtcgtaactacacagtcaatatattccttagcataaaattcatcaaatttgtcaagtccgttggtgaaaagtccgaatgtcgtacataccacgacgcgctcggcctttctctccttcagggctttggcggtatccagcatgctctcgccggaggaaatcatatcgtcgatgatgagaactgtcttgccttccacggaggaaccgaggaattcatgggccacaatcgggttgcgtccgttcacgatacgggagtagtctcggcgtttgtagaacatacccatatctacgcccaggttgttggccagatatacggcgcggctcatcgctccctcatcggggctgattaccatcaggtgatccttgtcaatcttcagtgtcttatcatgggcgaagagggccttgataaactgataagtcggcataaaattatcaaatccgtttaacgggattgcattctggactctcggatcgtgggcatcgaaggtaatgatgttgctgacacccatctggatcagctcttccagcatcatcgcacagtctaatgattcacggctggttctcttatgctgtctgccctcatataaaaagggcataataacattaacgcggtgtgcggtggcaaccgtggcgccgatgatcctctttaaatcctgaaagtgatcatccggtgacatatggttcgtaaaaccgctcattttataagtaaggctgtagttggtgacatccaccattgcgtagatatcggtaccacggacagactcatagacagctccttttccctcgccgctgccaaaccgtgggcaggcacagtttaacagataggaatctgcatcgtagccacggtattgaaggttctcctgcctttttttcagaatctcaatatcattgtggcggaagttaagaatatgttcatttactttaccggccaattccttacagctttccaaagcggcgatttttaaaggcgccaccggaagggtgtcattaaaaacatagtcattagacatgatgattgctcctccataaataagacaggaattcctgcctgacttttatacagtttttttataccattataagacaagaatcgtcaatagaaaaacaggaagttttaacaaaaagacaaaaactttacaaaattctgtaatgttgttatgataatgaatagagaaagaaagacgaaacagttcatgctgtcgaaccaatgttgtttagttaagcaggtgaggacgccgccggtacggccagcggacggggtggtggggtgtgtatatgagtctttcgtcccgggggaagattatcgtggtttggggctgcgggcgaagataaagtctgcggagcacgctcccgctctgtgaaatgcatcgcgctgctaagctcgagagaacctcgctaatcagcgatggatttcaacggcatccgcagactttatcttcccctccgccccaagggaaggttcaccgggacgaaagactccgccgggtgtattggccccgtccactggcctgcggccgctgattgtctcacgcgttaagtacggggcggaccttgccgcagccactcagtgcttccgtgtacgggaaatacgatatgcctacaatgcgcctttataaaaggcgctagatttgatatccgcccgcggaaacacgtagtggccgcgacatgggttcccccatttaaggttggagacaatcagcggccggagcggaccggggccggtgtgcgaaagccttcgcctgagtcttccgtccccggcgataacctgggccggggaagtaggcggaatcaattgcggaggggacatgggagtccgccggtgcttagcgaggtcccttacgagcttagcaccgatgcgcactccaaagagtgcaaacggtccccgcagcaattcattgcggccggattccccctcctcgaccaactttccacggggacggaagattcagccagagccccctcaccacaccggacatggtccgctccggacgcgtcctccacacctcagttaaatctccataatgttaactaaacgacattgctatctgaactgttaagaaaggcagaattaagtatgataaaacacggacatctgatcagcagggtcgatcccggctctatcgcggaggagcttgaactggaacctggcgatatgcttctgaccatagacggcgatgaaatcgaagatatttttgattatgaatatagaattgacaatgaggccattaccatggtcgtcagaaagaaaaatggggaagagtgggaactggatattgaaaatgaataccaggatctgggcctgacctttgagaatgggttgatgagcgattaccgctcctgcagaaataagtgtattttctgctttatcgaccagatgcctccgggaatgagggaaaccctctatttcaaggatgacgattccagactttccttccttcagggtaattatatcacgctgaccaacatgaaggataaggatattgaccggattatcaagtacaggctggcaccgattaacatatccgtccaaagcacaaatccggagctgcggtgcctgatgctgcacaaccgcttcgcaggtgacgccctgaaaaagattgacacgctctatgaggcggagattccgatgaacggccagatcgttctctgcaagaatgtaaatgataaagaagagctggagcgctctatccgggatctctcccggtacgccccctgtatggcaagcgtgtccgtggttcccgttggactgtcgaaattccgtgaaggtctgtatccgcttgagccgttcaccaaagaggatgccgaagagaatctggatatcattgaaaaatggcagaaaattatttatgaaaagcatgggatccattttgtccatgccagcgatgagctgtatatgctggccggccggccgctgccggaggaggagcgctatgacggttatatccagctggaaaacggggtggggatgatacgcctcatgacttccgaggtggaggaggccctgaaaacggcggacgacgacggaaaagaggaagagctgtcgatggcgaccggcgttcttgcttatccttatattaaggaatacctggagagaattaccggtatctatccgggacggaaagtgcatctttataagattgaaaaccactttttcggggagcggataacggtggccggcctgataaccggaaccgacctgatagaccagctgagagggaaagagcttggagaacgtctgctcctgccctgcgccatgttccggaacggggaagaggtttttctcgacgatgtgacgaaaagcgatgtacaaaaagctttacaagtccgggtggatattgtaaaatcaagcggacatgattttgtagatgctgtgctggggccggtagaagagacgaaggctgagcacggagcatatgaattaatgtaacagttcatgctgatttaactgctatgaattaattggaacggaggagtaatataattatgaataaaaagaaaccggttgttgccgtcgttggacgtccgaatgtgggaaaatccacgttatttaacgtcctggcgggcgacatgatttcaatagtaaaagatactccgggtgtaacgagagaccggatctatgccgactgtacctggcttgacaaggcgtttaccctgattgacacaggcggtattgagcccgacacgaaggatgtgatcctggcccagatgcgcgaacaggccgagatagccattgcgacggcagatgtaattatttttattgtggatgtaaggcaggggctgactgattccgattcaaaggtggccgacatgctgcgcaaatcgaaaaagccggtggtgctggccgtcaacaaggtggacagcttccagaaattcggcaatgacgtctatgaattctataatctgggaatcggtgatccggttggaatatcggcagcttcccggctggggctgggcgagcttttagatgcggtcgtaagccattttgaggacggaacaggcgaagaagaggaagacgagcgtccgagaattgccattgtgggcaagccgaatgtcggaaagtcctccatcataaataagctgctgggggaaaacagggtaatcgtatccgatattgcaggcactaccagggatgctgtggatacggagattatccataacggaacggaatatgtcttcatcgatacggcgggactgcgcagaaagagcaagattaaagaagaacttgagcgctacagcatcatcagaaccgttacggcggtggagcgtgccgatgtggtgctggtggtcattgatgccgttgagggtgtgacggagcaggatgccaagattgccgggattgcccatgaaagaggaaagggcatcattatcgttgtaaataaatgggatgccatcgagaagacggataaaaccatttatgaatacaccaataagataaagatgaccctgtcttttatcccatatgccgagtttatctttatttcggctgccacaggacagagaatcaacaaactttatgagattatcgatatggtcagggagaaccagacgctgcgcattgccaccggcgtgctgaatgagattatgacggaggcggtagcccttcagcagcctccgtccgataaaggcaagaggctgaagctctactatattacgcaggtctcggtgaaaccgccgacctttgtaatctttgtaaatgataaagaactgatgcatttttcatacaccagatacctggaaaacagaatccgcgatgcgttcggcttccggggaacttctctcaagttcttagtccgtgaaaggaagggaaaggagcagtaggtatggaacggcttatttgtgttgcaatcggttatgcattcggcctgattcagtccggctatctgtatgggaggattaaccatatcgatatccgccagcatgggagcggcaatgccggttccactaatgtgctgcgcgttatgggaacaaaggccggtgcggtagtattcctcggcgactttttcaaagcggttgctgcgatatgccttgtccgcgtactctttgcctcaggctcagacagcgtggatctgcttgccctgtatgcaggactgggcgttacgctgggacataacttcccgttctacctccgctttaaaggcggcaaggggatcgcctgcatggcagggattatgacggcgatggatttcaggattaccctcacctgcttcgtggtttttgccgtcgtggtggctgtgaccagatatgtgtctctcggatccattttggtatccataacctttttcgcggaactgattattttcggcaggatgggaagctacagggtagccgccctcagcctgcctgagttttacatattgggcggcgtcctgatgggaatggcagtctggcgccaccgggccaatattggacgcctgttgtccggaacagaaaacaaactgggagcatcgaaaaaatagcggaggattatattatggctgcaattggtgtgattggatcaggaacgtgggggacagctctgtccctgcttctttgtaagaatggctgcgaggtaacggtatggtctgccattgaagaagagataacggaaatgaaagagaagaggaggcataagaacctgcccgaagtagtgctgccggaggaactcaggctgacagcagatttgaaggaagccatggcggagaaggatattctcgtgcttgccgttccttccgtttatataagagcgacggcggcccggatgaaggagtttatccgatacggccagatagtaatcaatgtatccaaaggaatcgaggagagcagcttaaaaaccatgtctcaggtaattgaggaagagcttccggaggcagaggtggccgtcctttcagggccgagccatgccgaggaggtaagccgcgggatccccaccacctgtgtggcgggagctcaccggaaaaaggtggccgattacatccagtccgtctttatgagcccggtattccgtgtctatacaagtcccgacatgctgggaattgaagtgggagcagccttgaagaatgtaatagcccttgccgcaggcattgccgacggcctcggttacggagataatacaaaggcggccttaatcacaaggggaattgcagagcttacaaggcttggcgtcaggatgggcggtaaagaacagacctttgtaggactctccggaatcggcgatttgattgttacctgcgccagcatgcacagccgcaacagaagagccggtatcctgattggaaaaggatataccatggaagaagccatgaacgaggttcagatggtggtggagggggtttattccgccaaagccggcatgaagctggctgaggcttatggaatcgacatgccgattgtggagcaggtcaatcaggtgctttttgacggaaaaccggcgaaagaggcagtaaacgatctgatgctgcgtgaccgtagaatcgaaagcagcggccttccctgggaatcataaaaaagacaaaaagaaccgtttgtcttcctgatgacatcaagcgttcgcaagcgggagacaaaacggctcttttttgtcctttctatgaactgaggagatggcagctataacgacaagttatggcaagaaggaaattgaacggaaaaatgaagtttttctttcgatttccttttttttatgaggtttttgtattgacaattcaaattgttaaacttataatgtcgtcaatcaatccgttagcatgccatttgaaaatacctgaaaaatacggtgctgacagaagaattggaggagaagattatgaaaaaaagattactgagtttaggccttgcggtggctatggccgcatccctgactgcctgcggaagctcaggcggttctgcagagacgaaagctccggctggagagactaaggctgctgatgcagcaggtacagagacaaaagccgcagaagaagcagcagaatcagccggaggcgtatttaagattggcggaatcggaccgttaaccggaccggctgcagcttatggaattgccgttaagaacggaatggaactggctgccaaggagattaacgctgccggaggtattaacggtgcgcagattgaatacaacttccaggatgatgagcatgaccctgagaaagcaataaacgcttacaatacattaaaagactgggatatgcagatgcttttaggtacggttacatccaaaccatgtatcgcagttgttgctgagtctcaggttgataatattttccagattacaccgtccggttctgccgttgagtgtatttcaggggataatgcgttccgtgtatgcttctctgatccggatcagggtaaagcttccgcacaatacataggcgagcacaaacttgctaccaaaatcgcaattatttatgacagctctacagagtattccgacggtatccgtgagtccttcgtagctgaggccgccaaccagggacttgagatcgttgccagtgaagcattcacggcagacagcaacaccgatttctccgtacagcttgacaaggcaaaagagaccggagcagagcttgtattccttccgatttactaccaggaagcttccgttatcttaaaacaggcttctgataaagagttcagcccgatcttcttcggatgtgacggtatggatggtatcttaagtgttgaaaacttcgatacatctttagcagaaggattaatgcttttaacacctttctccgttgacgaggaaggcagcaaggattttgttgaagcttacagggctgcatataatgaagagcctcttcagttcgcggcaggcgcttacgacggcatgtatgccatcaaggcagcagcagaaaaatccggtattacacctgatatgagtgcatccgacatctgtgacgcaatgaaggcagccatgacggaaatcacgattgacggtttaaccggtacgggaatgacatggacggcagcaggagagccgaacaaggcaccgaaggctgttaagattgaaaacggcgtatatgtaatccagtaataaagcaatatagaattagcccttaaagagggttgtccgaaagacaaccctctttttaactattaatataccaaataaagacaaagaggtaggtgtaagcggtatgagttttctttcttatttaatcaacgggatcagtcttggaagtgtatatgctatcattgcccttggttacaccatggtttacggaattgcaaagatgctgaatttcgcccatggtgacattattatggtcggcggttttaccgtatttacgatcgtaagtacggcaggggggtcgccggtcgtcggggttctggcctcgattgtagtatgtacggttctgggtgttacgattgagaaggtcgcttaccggcctctgcgcggggcctctccgctggccgttctgatcacggctatcggcgtcagctatctgctgcagaatgtcgccctgttaatattcggttccaatgcaagacagttcacttcggtcgtaactctgccggcgctcaaactggccggcggcaagctgtccatttccggtgtaacgattgtaacaattattacctgcgtgataatcatgctggctctgactacatttatcaacaagacaaaaatcggccaggcgatgctggccgtttcagaagataagggtgcagccactctgatgggcatcaatgtaaacggtacgattgccgttacctttgccatcggttcctccctggctgcgattgcgggcgtgcttctctgttccgcttatccgtccctgacaccatacacaggctccatgccgggtatcaaagcattcgtagcggctgttttcggcggtatcggctcgattccgggagccatgatcggcggaatcctgctcggagtaatcgaaaatctggcgaaagcctatatctcttcccagctggctgatgccatcgtgttctccgtactgattatcgtgttactggtacgtccgaccggcatccttggtaagaagatcaacgagaaagtgtaggtgaataggatgaaatcatataaaaataaaatcttgattcagaatactatcacttatgcactggtgatagcggccttccttctgattcagatcctgatggccgggggccatataaacagtcttttaaagggaattctcgttccgctctgcacctatgtcatacttgccgtatccctgaacctgacggtgggaatcctcggggagctgagcctgggacacgccggttttatgtgtgtgggagccttttccggggcattttttacccatgttatggcagcctccattcccaacccgcagctccgctttattatcgctctctttgtcggtgcggtcgtagcggcggcgttcggcatcctgatcggtattccggtgcttcgtctgaaaggagattaccttgccatcgtaactctggcttttggtgagattattaaaaacgtgattaacgtgctctatgttggcacggacgcctcgggtatccatatctcaaccaaggatgtggcctccttaaacctggctgaaggcggcaaggtcatcatcaagggcgcccagggtatcaccggaacgccgaagatggcaacctttacgattggcttcattctggtgctgatcaccctttttattgtcctgaatatgattaattccagaaccggacgcgccatcatggcaatccgcgacaaccgtatcgcggcagagtccatcggaattaatatcacaaaatacaaattgctggcattttccgtatcagctgccctggccggcgtggcgggcgtactctatgcccataacctggcaacacttgccgcaacgcccaaaagcttcggctataatatgtcgattatgattctggtattcgtcgttctcggcggcatcgggaatatccgcggctccgttattgcggcggtcatcctgaccctgcttccggaaatgctgcgcggtctcaacaattaccgtatgctgatttatgccattgtgctgatcgtgatgatgcttctcacggcaagccccaaggcgattcagattcgcgaaagatggatttcttccatcaggaaaccaaagacaaaggaggaggcgtaggttatggcaatgctggaagttaaaaacttgagtatctccttcggcggcctgaaagcagttgatgactttaatgttatgattgaaaaagggcagctctatggactgattgggcctaacggagccggtaaaacaacgatttttaatctgctgacaggggtttataaaccggactgcggccagattaccctggatggaatgaatataacaggccggaaaacggccgatatcaataaagctggagtagccaggacgtttcagaatatccgtcttttcaaggaactgagcgttcttgataacgtaaaggtggggcttcacaaccactacaagtattccaccctgtcgggaatttttcgtcttcccgcttatcacaaggtggaaaaacagatggatgagagggcaatggagcttttaaaagtttttgatatggatcaggaatttgactgcaaggcttcaaatctaccttacggaaagcagcggaagctggagattgcgagggcgctggcaacggagccgaagctccttctcctggatgaacctgcggccggcatgaaccccaatgagacggcggagctgatgaacacgatccgctttgtcagggataattttgatatgacgattctcctgattgaacacgatatgaaactggtatccggaatctgtgagcgcctgaccgtgctgaacttcggccatatgctggcggaaggccccacaggcgaagtgctgaataatccgcaggtaattgcggcatatctgggagaatagggaggaggtcttatggcaatgctggaagttaaggatttaagtgtatattatggcgtcatacaggccctgaaagggatttccttcgaggttaacgagggagatgtaatcgccctgattggagcgaacggagccggtaaaacgaccaccctccatactatcacaggactgattccatctaaatcgggcagtatcacgttcgaggggaaagacattacaaaggtaccgggctataagctggtgccgatggggattgcccatgtgccggaggggaggcgtgtatttgcacagctctccgttctgcagaacctgaaaatgggcgcttatacgcgaaatgacaagcaggagattgaagatactctgacaaagatttataagcgcttcccaaggctggaggaaagaaagaaccagctggccggaacgctttcaggcggtgaacagcagatgctggccatgggccgggccttaatgtcccatccccgcctgattgtaatggatgagccgtcgatgggcctttcccccatctatgtgaatgagatcttcgatattatcaaggagatcaacgcagacggcaccactgtacttctggtggagcagaatgcgaaaaaggcgctgtcaatcgccaacaaggcttatgtgctggagacaggaaagattgtgctgaagggcgacgccaaagagcttatgaatgatgactcggtgaagaaggcttatctgagcgagtaggaatataggatttgtcagacagtctggcaatatgaaggcaggagagagacttacgtggttacgatatcattaccgcatgaatttctctcctgctttttaaaataattgtcagaaaaaagaaaggtatggacatacctcttcgccaatattttttagcatacgcccccttcccccttgcatatacttgtatcagcatagccaagggggtatttttatggacaattttaacgtatacagtgacattaaggccagaacgaatggggaaatctacgtaggcatcgtaggtcctgtcagaaccggcaaatctacctttatcaagcgcttcatggaactgatggtgctgccgggcatggacgatccgcatgcaagggagcgcacaagggatgaactgccccaaagctccgccgggaaaaccatcatgacgacagagccgaaattcatccccaaggaggcggcccagatcgcgctcagcgacggcgttgacgtcaaggtcaggctcattgactgtgtcggtttcatggtggaaggcgctgccggccatattgaaaatgatacggaacgccttgtgaagactccctggttcgatgcggagattccgtttaccgaggcggcggagatcggcacaaggaaggttatcaatgaccactccaccatcggtctcgtcatcacgacggacggttccttcggagacattaagcggggaaattacatagcggcggaagagaagacgatcaaagagcttaagaacctgaaaaagccgttcctggtgcttttaaactccatgaggccttattccgatgaaacaagggaactggcaaagcagatggaggaaaaatacggggttcaggttatgcctgtcaactgcgaacagctcaaaaaagaagacattaaggcgatcctggaagagattctgcatgaattcccggttacggagattgacttcaccattcccaaatggatggaaattctcccgcgtgaacactggcttaagagccgggtgatccagaccgtcaaggaaatgctcaaaaagacggatcatatgcgcgatgcccaggaggcgcttccggaagaggataaggaagccgtcagaagaattaaaatcacagggatgaagatggccgacggcagcatccaggcccaaatcgaggtggatgacagccattactaccagattttaagcgaatatgtcggcgtcccgatcgagggggaatatcagcttatgcagactttaaagagcctggcctcgatgcagaaggagtatgagaaggtgagcaatgccgtatgccaggtgcgccttaagggctacggagtcgttacgcccgaccgctctgaaattgtgctggatgagccgcagctaatccgccacggcaacaaatacggtgtgaagatgaaagctcaggcgccgtccatcaacctgataaaggcccatattgagacggagatagcgcctatcgtgggaagcgaacagcaggccgaggatttgatcacttacataaaagaaaatgcaggacagagcgaagagggcatctggagcaccaatattttcggaaaatccattgagcagattgtggatgacggaattcaggcgaagatttcccagatgacggaggactgccagatgaaattacaggatacactgcaaaaaattattaatgacagtaacggcggtatgatttgcattattatctgatatcgggtatacttaaaccatcagttttggcaaaaataaatacagtacaggagatggttaaatgagattaacttttatcggtgcggatcacgaggtaacgggaagctgtcatttattgcaggcatgcggtcttaatatcctggtagactgcggtatggaacagggaattaacaaattcgagaatgcagagcttcccatcagttactccgatgtggactatgtgcttgtgactcactcccatattgatcacgtgggaatgctgccatttatttatgcaaggggattcaggggccaggtgatgggtaccagggccacctgtgatctctgtgagattatgctcagggactgtgcccacattcaggagacagaggcggagtggaagaacagaaaggcaaaacgtgcaggtaaatcggaagtgcctccgctctatacgatgaacgatgccaatggagtgctggagcattttgtgccctgcaattacgaccagattattaaactgaaggaaggctttgagatacgttttaccgatgtaggccatcttctggggtctgcctccatagaaatctggatgacggaagaggactgttcgaagaaaatcgtcttttccggcgatatcggcaataaaaacaaacctctcatcagaagcccgcagtacattcatcaggctgactatgtggttatggagagcacttacggcgatcggttccataagcataccggcgatcacgtggaggaatttgcaaaagttatcgaggagacgctggaccgcggcggtaacgtggtgattcccgcctttgcagtcggccgtacccaggaggtcctcaactatatcagggaaatcaaggaaaaacatcttgtaaagggccatgacaatttccctgtctacctcgacagccctatggcggtggaagcaacggcagtctttaaggaaaacatgatggactgttataatgacgagacaaaagccctgattaagaagggcatcaacccgatttccttccccggcctgcgtctctccgttacaagcgacgattccattgccatcaactttgacgaagagccgaaggtgattatctcggccgcaggcatgtgtgatgccggacgtgtcagacaccatctgaagcataatctctggagaccggaatgcaccattctctttgccggatatcaggcggtaggcacactgggccgcagtattgtcgagggaagagaagaagtaaagctgtttggtgaatcgatagaagtcaaagcccatatagaaaagatagagggcatcagcggccatgcggatcagacagggctgcttgagtgggtcggcagtttcatggaacggccgaaacatgtcttcgtcgtacacggcgatgatgaggtttgcgacacgttcgcagctacggtaaaagagaaattcggcatggaggcagacgcaccgttcagcggaacctcctatgatttaaaagagggctgctttattactgttaccgagggcattccgatcaagcgggaagcggagccggctaaaaaggccgcaggtgtattcgggcgtctggtggctgccggtgaaaggctgcgcagagttattctgaataacgaaggcggcgccaataaggatctggcccgtttcgcagatcagatcaattccctctgtgataagtgggacagatagaaaagactgagaatgaacctgcaaaggagagcataatttgaaagtggaaatttatacggacggttccgccaggggcaatcctgacggaccgggcggttttgggaccgtgcttcattaccgcgacggctccggccagctgcatgtgaaagaaatatccggaggatataagcggactacgaataacaggatggaactgatggctgcggtggcaggcctggaagcgcttaaccgcccctgcgaggtcagtctgtattctgactccaaatatctggtggatgcttttaaccagcgctggatagacggctggataaaaaaaggatggaagcggggaaagaatgaacctgtcaagaacatcgatctctggcagcgccttttggccgccaaagagcctcatcaggtgacttttatctgggtaaagggccataacggacatcctgaaaacgagcggtgtgactttcttgccacatcggccgccgatggggacaaccttctgacggatcccggagtgcaatgacattcagcatctccgcgccaggccgccgtttccaataatctgagggcaaagtcctcccggctgtggaccaaagcagccgggaggtctttatttattaaatatatcttacaaagtattacttatttttggaacctatttcctttcctgcgtaaatatgatatctttattttaaataacgcgaggatggataaatattgaaaaatagaggcgtaataattgcaattattttgattttaataatgggcgcaggggtgactgccgggacaaaacgttttataagcgataaaacgtcgggcagtcctatgcctgttttggaagaacaggcttcgccttcttccggtcagggcatggagagtatgcctgtagcggccgccgggatcactactttctcagctgacggtgaagcgggggcggaggactccggagaaggaactggaactaaaactgaagccggacagacttttagtgcggcagatacgaaagagaaggacggcagccagacggaaggggctgccgatagaatatattattccagaagtagtgatacggccggagagacagagcagacggcggcggccgtttcggaagaacttaatcaggcggcggctccggctgccggttcatcattgcctggagagagttctgcagagatgaaaagcagtgttgtaatatctccgctcaccggggtgaacgaatcggatgctgtaatcgccgataactccaaaacactggaaggctaccggaaaaaactgagcgagatagacagcctggttcagaatatgcagagtgcggaagcgggttccaatacggattccctgaaaaatgtcgcagactatgaataccgtctttgggatacggaattgaaccgcatttaccaatccctgctggagggaatgacggaggaagaatcggaagctcttcgggcggaagagagggaatggatccggacacgcgacctcgctgccaaaaaagcggcggccaaatacggcggcggaacgatggaaagccttgaatatacggcttcattgtctgcttctacgaggagccgtgcctatgagcttttggacagctatggtgactatttagaacaggaagaagattgaccgggattctttaaatgcagagtaaagccttcacagccggagtgcggccgtgaaggctgttttgtatgatttcctcttgataaatggattttcctatgataggatataaagaatgaagaaatatatagaaaagacagaaacttacaggaggaagcaacgtggaaaaatacggtgtaaacgaacttagaaggatgttcctggagttctttgagagcaaaggacatctggcaatgaagagtttttctctggttccacataatgataacagtctgctgcttatcaattccggcatggcgccgttaaaaccatattttaccggacaggagatcccgccgaggaatagggtgactacctgtcagaagtgtatccgtaccggcgatatcgagaatatcggtaagactgcccgtcacggcactttttttgaaatgcttggaaacttctcattcggtgactattttaagaccgaagcaatccactggtcatgggaattcctgactgaggtggtgggactggatcccgaccgcctttatccgtccgtttatctggaggatgacgaggcgtttgatatctggaataaagagatgggtatccccaaagagaggatattccgtttcggcaaagaggacaacttctgggagcacggcgccggtccatgcgggccatgttccgaaatttactatgatcgcggcgagaagtacggctgcggcagtcctgactgtaccgtaggctgcgaatgtgaccgttatatcgaagtctggaacaacgtattcacccagtttaataacgacggccacggcaactatacggaactggagcataaaaatatcgatacaggcatgggcctggagcgtctggctgttgtagtgcaggaggtagactctctgtttacggttgatacaaataaggctttactcgaccgcgtatgtgagctggctcacacaaaataccaggaagaccacgaaaccgacgtttccctgcgcattgtggcggatcatatcaagtcatgtaccttcatgatttcggacggaatcatgccttctaatgaaggacgcggatatgtgctcagaagacttttaagacgtgccgcacgtcatgggaagaaactgggtatcgaaggtaaattcatggcagaactgtcaaagacagtgattgccctttcaaaagacggttatccggaactggaagagaagagcgccatgatttttaaagtgctttccgaggaagaagataaattcaataagactatcgatcagggacttgccatcctggctgatatggagactgagatggcaaagaacaatgagacggttctttccggcgataacgcattcaagctctacgacacctacggcttcccgattgatttgacaagagagattctggaggagaaaaatctctccctggatgaggacggttttaccgccgcaatgaaaaaacagaaggagcaggcaagagcggccagaaagacaacaaactatatgggcgcagatgtcactgtataccagtctatcgatcctgcagtcaccactgaatttgacggttacggtaaactggcggaagaatccgagatcacggttcttacaacggaaacagagattgtagaagctctgactgacggacaggccggtacaatcattgtgaagaaaactccgttttatgccaccatgggcggacagcaggccgacgtgggagtaatcaccgcacaggatgccgagtttacagtaaaagatacaattaagcttcagggcggtaaggtaggccatgtcggttacgtgactaaaggcatgttcaagacaggagataccgtaaccctgaaggtcgataaagagaacagagaattgacggaacgaaaccattccgcaacccatctgcttcacaaagcgctccgcacggtactgggtacccatgtagagcaggccggttctctggtgacaaaggacaggctgcgttttgacttcacacatttctccgccatgacagacgaggaaattgccgctgtggaaaaactggttaacgacgagattgccgccgctcttccggtcgagacgatggtcatgacactggatgaggcaaagaagacaggcgctatggcattgttcggcgagaagtacggcgacagtgtaagggttgtaaagatgggggatttctccaccgagctctgcggcggtactcatgtggataataccagcagtatttctgcattcaagattgtatcggaagcaggcattgccgccggcgtaagaagaatcgaagcgctgacatccaccggtctcatgaattactataaggagatggagaaggaacttcatgaagctgccagagtcgttaaatccacaccttccggactgacggcaaagctggaatccatgctggatgagattaaggcacttcactctgagaatgagaagttaaagagcaagctggctaatgattcccttggcgatgtcatgaaccaggtacaggaggttaacggcgtaaagctcctggccgtacaggtaaaagacgtggatatgaacggcttgaggaatcttggcgatcagctgaaagaaaagcttggagaaggcgttgtagtgattgcgtccgtacaggacggcaaggttaacctgatggcttcggtaaccggggaagctcagaaaaagggcgcacatgccggaaatctcatcaaagcaattgccggacttgtcggaggaggcggcggcggaaggcccaatatggcccaggccggcggcaagaatccggccggtatcccggatgcactgaaaaaagctgccgagaccgtacgggaacaaacaaaatagagtcagaacagattagggatatcgataaacgatgacctgcatgctccgcgcacaggtcacagctttcaatcaaaggaagaagaaccgttacggcaattgaactgctccggttcttctttctttattacttttctttatatctgaaacagcatttacagcactgcggcttcgaaggtaccggcggctttggcggacacgacggttttggcgggcacggcggctttggcgggtacggcggttttggcgggcacggcggttttgggggacatggcggcttcggtgggcatggtggcatcataggccacagcccttcagtctgccatggataaagggtccagaacacaggaaaccaccagccggaatacatcattccccaagggcattgcgaaaccggaagaaagccttcattcccgctgtcagcatagctgtaatcattattggaattatgatagctgctgttatttctttcactgccgttattgcactcatagcccatacggctgtcgttattatcaaaagatatgggattgctcatgcattattcctccttttatagatgtggacggacgctaatttgtcctgtttttatatagtatgacaggccggccgggaatgtcccgtttttaaagggatattaaatcacagaatcaaatacttgaaaaacaatttgaagaaatttcaagaaaacatgaaaatcctgttgacgtatggaatttttatgatataattttactagtgctaaaaaaatacccaaacagttgtattaatatgcacttattacacaactggagggaggttaggtgtgagctatgtcaaatgtaatcgttaaagataacgaaagcttagacagcgctttacgcagattcaaaagaaactgtgcaaaggctggtattcagcaggagattcgcaaaagagagcattacgaaaaaccaagcgttcgtcgtaagaaaaaatccgaagctgctaggaaacgcaaatataattaatcaaacgataatctgattgctttacgcacaggttactgtctgcaatgatgaaaagtccgcagtgcgtacttttcaccgaaaatcaacgaaacaaaatccctggtttattaagccagggattttttactctgtatgggaagactgtttattttcagaaaaaggaaacaaaacagccagaagagaataacgtgaggaggagaattcatgacaaagataaaaaggagagtaatatgggctgccatagccgcatatgctaccgtgtttttcctgaccagtgatacactccttgcatttccgcttttaatggaaccttcctcggtattctgcctgccggtaacggctggtatcgctttcctttatctgaaagcattttttccttttgaccggagacggattttaatcagttttgtatccggtatcctgatggggctgatgtttatcctgggagtcaggtattccgtcaacgaggtaccggcgccttcggccttcagctttctgactgcgcttctggcagcggcattgctgttttctgcatttataagcctgcttcttaagagtctgtcccttgtaccggcacgtaccggttcagcggcagcagaaaaaacaggcgtaaagacattagccgcactgtttgccgtcacctttgccgtgtatgcggcagcatttctggcggtatatccgggaatttactcctatgacgcttccgttcaggttttacagtttttcggcgataatccggttaccagccatcatccgattctgcacaccttatttctttgcggaagtctgaaggcgggggaggtactgtttcacagctatcaggccggacttgccctctacagtctgattcagattacctttatggcagcggtaatcacctttgtcctgtaccgtatggttcgaagaaacgttccaaactggctggttattctctcctggctctttttggcggccaatccctatatgcaggttcttgctttactgacaaccaaggatgttctgttcggggctttcttcctgctgacctttgatttttcgattgacatggtatctgatccggaacgcttcttttcaagccggattatgcaggccggtttctttctgtctgcgttcttttcctgtctcttccggaatcagggaatccatgtatttatatttttctcgctgtttgcactcgttttctttatccggcataaaaacagcggtaaagcccgtaaactggctctccgatggaccatctgtgcggcggcgctgtctgccgtgtatttgacattaaacggccctgttctcacagcgttcggcgtagaaaagggggatgccagggagatgcttagcgtgccgatgcagcagctcgcgagggtctggcacgaagcgcctgaaagcctgacgagggaagaaaaggcttatattgaatcgctgatacttcctgaggccctggatggctacgtgagggtaaatgccgatccggttaaaagcggttttcagacgaatgtcgtcaaagaagatccgttaaagtttgtcggaacctgggccggaatcggggcaaaagaaccgctcatttatctggactcttttctgatgggcaactggggatactggtatcccggagagacacagtactggatcagctacattatgtttgacggtgcatttttggaggatgaatataacgttcttcatatcttccggaacagccgttttccctggtataataattatctgaggacaatcagcctgaccccggaatttgaaaagattccccttttgtcgctgattctgaatcaggcttttccattctggctgatgcttgcggccgggactgtatctatatatagaaagcagacctgccttctcgtgtctttgtcgctgattctggggtattgggggacgctgctgcttggccctgtgaccggtgtcagatatgcctttcctctgatgctgtgcgtgccgctgctgtttgaactttttatgtatgggacagcggggagagttgagaattaattgagaatgggaggatgcgtccggaacggaccggggccggtgcggtggggagtcagtccgctggccgtaccggcggcgtcctcacctgcctaattaaatctccctgctgctgcgaataaatcaaaataaaatttcatataatctctataaggattggaaaaggcggtacgctattgttaaacaggcaaaaaaaagcggtagtatcggccctcaatctgccggaagatgtcttttttggagagatgcttctgttctttaccggcagccattcggctgtggtggaaaattacagaagcattgttctatttacggacacggtgttaaaacttcagggcaaaaccacgaagctcacagttaccggaaagaatttttctatcgaatattacgataaagaacagctgaaactgacggggcagataaggtcggctgaatttgaatctatctgattctgattccaggaggagttatatgaaatcgatacgcaggttttgttccggcagcgtccggatccagatgacaggcgagtctccggaacgtttttttaatttatgcgccgcttccggcttagatatctgggacgttatattttcaaaaggcaattacatattttcaatgggcatacacgatttcttttccagtaagccctttataaagaaagcgaagatcaggcttaggatacagcaaaaactgggacttcctttttttttacataaaaacagaaaaaggaaactgtgggcggccggtttcctgagctttttcgtatttctgtgggttctctcattctttgtatgggatatcggatatcagggtaatgtaatgtatacggatgacgaactttctcattttctcgacactctcggaatccactgcggaatcatgaaaaaccaggtatcctgcgaggagctggaggctgcgctgagaaatgagtacgagggcataacttgggtatcggcccgcttaagcggaacgaagctctatatccatgtcaaggaaaatgatgtgccactggaaattccggtcaaagatgattcgccctgtgatttggcagccgagtcagacggaacgatcacgtccatgattgtcaggagcggtattccccttgtaaaacccggagatgaggtggaaaagggacagattctggtcagcggcatggtcccaatcacagacgacggcggaacggtgatatcagggcgctatgtccattccgatgcagatattatagctgtcagagagaggacggaatccagggaaatacctctgtggcatgaaaaagaggaaaaaacaggccgcgtccggaaaggactgatgatgaacattaaggagcactcgtttgtatggctgcttcccaatttcaggaatacagagtggaagacggtgactgaaatcaggaagatcaggctttttggtgatttttatctccccatggagctggggtttatcacctccggcgaagtctcttcctatgacgtaaaatatacggaaaaggagctggaggagctgggtgaggcttataaaaatgaaattgcggaaaaattaatggaaaaaggggtacaaattattgaaaataatgttaaaatattagttaatggctcctcttgccgttttgaagtaacgatgcggacagaggaatccatcgaaatggaaacagaaatagaagcacaaggagaaacacaaggagaacagccagccgatgagcataattgaaacagttatagatattcccatggaacatgtacaaaatgtctgcggccagtttgatgcctaccttaagaaaatcgaacggactctgcatgttaccatgattacaagagatggggcgctgaagattatcggtcccgaacaggctatcagacaggccaaaagtgtttttaacaacctgctggagctttccaaacgaggcaataccatcacagaacagaatgtcgactatgcaatttccctttcctttacggagcaggagggccagattcttgaaattgataaggatatcatcagccgcactgtaaacggaaggcctataaagccgaaaaccatggggcagaagcagtacgtggatatgatacggaagaaaatgatcgtctttggtatcggaccggccggaacaggaaagacctatcttgccatggctatggccatccaggcgtttaagagcggtgaggtgaaccggattatcctgactcggcccgccattgaagcgggagaaaagctgggctttctgccgggcgatctgcagagcaagatcgatccctatctgcggcctctatatgatgcgctgtatcagattatgggagccgagagctaccttcacaattcggaaaagggactgattgaggtagcgcctcttgcttatatgaggggccgtactcttgacaacgcctttatcatcctggatgaggcccagaatacgacgcctgcccagatgaaaatgttcctgacacgtatcggtttcggttcaaaggtaattattacaggagaccagtcccagaaggatcttccggccggagcggtatcgggactcgatacggcagtaaaagtactgaagaatatagacgatatcggattctgcttccttaccagcagtgacgtagtgcgccatcctctggtacagaaaatagtggaagcctatgagagctttgaactgaaggagaaaagggatacgccggagggcaggagatatggaggccgggggcgttcctcttctgatgacaggccgtcgccgaaagggagaaaaaacaaatgacaattaatatcgaatacgaagccgagaagaagctgaacctgccttatgaatccatcatagaggatgtggttaacgcctcactggattatgaaaaatgcccctacgaggcagaggtcaatgtcatactgacggataatgcggagatccggagaattaaccgtgaattccggcaaatcgacagcccgacggacgtgctgtcctttccgatgggtgattttgatgttccttctgattttgaacgcatggaagagcagtctgaggattattttaaccctgagaccggggagcttcttttaggcgatatcgtaatttcggtggacaaggtagaagaacaggctgaaaaatacggccattcccagacaagggagctggcttttctggttgcccacagcatgctgcatctttgcgggtatgatcatatggaagagcaggagcggattgccatggagaagaggcaggaggaaatcctgagtacaggaggttttgccagatgatgaaacggggggttatactggcgctggcagccggactctgtctgagtgcaggctgcaccaggtatgaggaagtgtcggttacggccggcgttaaagagacggaagagacaaaggtgattcagattacggagccggagacggaaccggagacagagggtgacagggaacttctgcgtatcgagaaggacggcaagatccccagctatcttacgggggaaatgacggacctggcaattgcatggcggcggcctgttgcgatcatgataagcaacgataaagcggccttgccccattatggcattaaccatgccggagtgatctatgaagctcccgtggagggcggaatgaaccgtttcatggctgtaatagaggattatgacaatctagagcgtattggttcggtgagaagctgccggacatactataccttttttgcacgggaatttgaagctgtctatgcccatttcggccagagtgttttcgcacgtccttatctggaaaagatggagcatttaaatgggattgagggaaaaggttccgtggctttttaccggaccaaggataagaaagctccccacaatgcatatgcaagcggagaacgcattcaaaaagccatagaggctatgggatattcccaggaatatccggaaagctacaccggccattaccgtttttctaaaaaagagtatccggtcatgctggagaatgggttttcggcggcgtttgtgcgcccgggatacgttatgaatgatccctggtttgaatataatgctgacgacggcctgtattaccgttttcaatacggcggcccgcacaacggcgacgagggccagctgacggctaaaaatattatattccagtattgcggctggaaatattattcatcgtccgaatatctggatatagatgtacatagtcccgggctgggatactatttcaccaatggaagaggagaacggctcacctggacaaagggcagcgctgacgctgtgacaaaatactataatgaaagcggtcaggaaatattgctgaatccgggcagtacctggatttgcatcatacaatctgaccggatggataaggcggaattttatggagaacagacagagtagacgtaaaacaaagggcaaaagggaatcgaatttcgttgtccagggaagtatcctggcagtggcggggatcattgtaaggcttatcggcatcctgtaccgggttccgatgaccaatattatcggtgacgagggaatggggtattattccacggccttcaatgtttataatatcatgctgatcctttcttcctacagccttccgctggcggtatccaagatggtatccgcgaggatggcgaaagggcagtaccggaatgctgtccgggtgctgaaagcggcccttgtctatgctacggtggtgggaggaattgcctgctttatcacctggaattttgctgatttctttgcaaccacagcgtttaatacgcctttttgtgtctatgcgctcaaaacactggcacccactatctggattatggcctatctgggcgtgctgagaggattcttccaggggcatggaaccatgattcccactgccatctcccagatttttgaacaggtgatcaatgcggtaatcagcgttgtggccgccggtgttctgttcaagatcggcctggattccaaccgggtttacaatacgaccggttatccgcaggcattcggagcagcaggaggaacgatcggcacaggtgccggcgctctggcggcgctgctctttatgctgctgttattttccatctactggccggtggttaaacgcaggaaacggcgggacagaagcaggcgcaccgattcctacggggatatctccgtgacatttttatttacggttgtgccggttatcatcagttcggccgtctataatatcaatgccgttgtagataacagcattatggcttacggaatggaggcgctggggcgcggaaaggaatttctgtctctctggggtatctacaataacaaatatatgcttttggtccacgtgccgctggcaatggccaattccctttcttcctcgctcatcccgtcactttccggggcggttgccagaaaggaaaagggggcggttatcgccaagacaagccttgccatccgttttgccatgctgattgccatcccgtcggccgtagggctgaccgtcctttccgctccgattaataatctgcttttcaagagcggcgacaacacagaggctatcaggatgctgattaccggttccgcggcagtgatattcctgtccatgtcgacagtgaccaatgccattttgcagggcatcaatcatatgaatgtccctgtcagaaatgcattcatttccctgatccttcatattggggttctctatctcatgctgatggtgtttaagatggggatttacagtatggtgttcgccaacattgcgtttgcggtattcatgtgtatcctgaacgcaattgccatccggaggtatctgaattaccggcaggagattgtaaagacatttctgctgccggccgttgcatcagcttttatgggggcggcggcattcggagtatacaagggcgtgaccctgattataaaaagcaatttgcttggaactatattcgccgttctggcggcaattgccgtgtacggggtgctgttaatcaagctgcgctgcgtagatgaggaagaactctattccatgcccggaggcacgaaagtgatccggctttcaaggaaactccatttaatgtagggagttaattgagtaaggaggacgcggacgggaacgtccatggtccggtgtggtgagggatgtgtatgagtcttcagtcccctttggcaggtagccgtgaagggggaatcgccaccccgtccgctggccgtcccggcggcgtcctcacctgcttatttaaattcataccagcatgaggatgtttaagatagaagaaaaaggcagatactattagtacttaaggaggaattccatgaaaaagtattatatctgcttttttctgttagcggtatttttagctgcatccatactcacgggagcgtatatttatttttaccggcctgagcatgcccagcccgtaccgggccagattctggagtcggagtcggcgccggaggataatgtggtaattaaccagaggcaggttgagacaagagaggaaataaagaattactgtcttgtggcagaagaaggttttcttctcgtctttgcaaaggaccgtgacaatgtatgtctggatacccatatgccgctctcagaatttccgctcagtgagcaggaaaaattaatggaggggatctggttttcatccatgatggagatattcaattatctggaatcctacagcagctaaaacgttactgttcacacggttgtgttccgcgaggtgttttcgtgcgcattctgcacgaaaatcccgagtttcacggcgcgaaacggcgttttttgccgtttctgtgcatcgcgaagcgtgttattgttcacagcacgccgctttttggcggggtgtgaacagtaacgctaaaacttagtgccgcggcgcgatgaaaagtaaacttttccccacaatcaacggcgcttttttgccgtttctgtgcatcatttgttgcagtttggccgaaggctgaacagtgacaatgtgaccaataccgccgaaaaaaacgagacaggagtcggattaagtatgaaaaaacaggtaacaatcattggcgccggagcctccggcatgacagcagctatcttcgccgcaagacagggcgcccaggtaaccctgctggagcatatggatcgggttggaaagaaaattttgtctaccgggaacggtaaatgcaacctttccaatcgttttatgggggaaacctgttaccgaagcggagtggctgattttcccatggaggtaatcagccgttttaccgtggaggaaacactttccttttttgaagatctgggaatcgtcgtaaaagacaggaacgggtatctgtacccccactccgggcaggcttcttctgttctcgatgtgctgagagcggagcttgaccaccgccggatccgtacggtaacggagtgccggattgatgcggtccggtacagggaaacaggagataaacggttcaaagtctccacctctcaggggagcttcctttccgactgcctgattcttgccaccggttccaaagcggctccggcaacaggttccgatggaagcggctaccaactggcagagcagctggggcatcatatcataaaaccgctgcctgcgctggtacagcttcggtgccgggaaaaattctataaacagatttccggcgtacgcacagacggctgtgtatcattgagatgcggcagcaaagagctggcaagagaccagggggagattcagctgacggattacggtatttccggcatccccgtattccaggtcagccgttatgcatcaagagccattgaccgtggggaaaaagttactgcggttttggatttttatccggatgcgacatttgagaagacacgccgaatgatggagggacgcaaattaagctgttccagtaaacccatggaggatttcttcaccggctggtttcacaaaaagctggcagctttatttataagactggcaaatctggaaccacacaagcaggccggtttgctgaccgtggaagagattgaccgtctgacctgcgttatcaaagaatttaccacggaaataacagcggccaatccgtttgaaaacgcccagatttgctgcggaggagcagatgtccgtgaaattgctcctgaatcaatggagtcgaaacttaagaaaggcctgtatctgataggagaactattggatgtggatggtatctgcggaggatacaatctgcaatgggcgtggagtaccggtgcgatagcgggaactcacgcaggactgtaatatgatacgtatcaatcagttaaaactgtccgtgggacacacaaaagccgatatgaagaaaaaagcggcaaagatgatgaggataccggaggataaaattctttccctcgtgccggtcagacagtccctggatgccagaaaaaagaatgagctgctttacatatattccctgaatgccaccgtttcaggaaaagaaggagccgtaattaaaaatgcgaaaaatgtaaatgtggtgctgaataccgaaaaaccataccggtttccggagcatggacaagagccgctttgccacaggcctgtgatcgttggatttggccctgccggcatgttctgcggcctgatgctggcaagagccggcttttctcccctgattctggaacgcggtgaggatgtggattccagaacacagaaggtggaggctttctggcggggcggagaacttaatccggaatcgaatgtccagttcggagagggcggagcaggaaccttctcggatggaaagcttaacacattagtaaaggatccgtccgggcgtaataaaaaagtccttgaaatcctggcagaggcaggcgccgacccttccattacctacataaataagccgcatgtcggcacagatgtcttaagccgggtggtaaagaatatcagacaggaaattatccggctcggcggcgagatccgttttggctgtaagctgaccgacttctcagaagcaggcgggcgccttatctcggtgaccgtgtctcagagggaagagggaggcttttaccgggaagaaacgataccggcacaggcagtggtgcttgccatcggccacagcgcacgcgataccttccgtatgctctcggaaaaaagcctggacctccaggcaaaggcttttgcggtggggctgcgcatccagcatcctcaaaagcagataaatttctcccaatatggagtggaggagcccggctcactgggcgcggcaagctataagctgacgaagcagacttcttccgggcgcgggatttattcattctgtatgtgtcccggaggctttgtcgtcaatgcatcctcagaaaccggccgtcttgccgtcaacggcatgagcaaccatgacagggcgggaaccaatgccaacagcgcccttatcgtgaccgttacaccggaggattttccaagtcccggaccgcttggcggagtcgaatttcaaaggaggctggaggaagcggcatttaactgcggaaaaggaaaaatcccggtacagctttacggtgattttaaagcgggtaccctttcccgggctttcggggatgtggaaccggccttcaaaggagggtattcctttggaaatttaagggaagtgctgaatccgtctctgactgatgcaatgacggagggtattgatagttttggccggataatcgacggcttcgaccgtccggatgcaatcctggccggaattgaaagccgtacctcatcaccggtccggataccgcggaccccagaactcgaaagtgcagtccgcggactctacccctgcggggagggggccggatatgccggagggatcacttccgctgcaatggacggcataaggacagcagaaatgatcgttaccagattttcgccctctttttattgacgtgtttttataaatgaggtaaactggcagaaacgatgaaagaaatacatctgtaattaatagtgacattacttagaaactatgaggggaaagaggattttatatgacagatttcagggcagcattaaaagaaaaaaagagaattgttataaaaataggttcgtcctccctgacgcatccggagacaggggatttgaatctgagaaagattgaacagcttgtacgtgtattaagcgatctgcggggccagggcagagaagtgattcttgtatcctccggagctatcgccgccggacggcaggcgctgggcttcaacgaacggcccaggctgctggaagaaaagcaggcatttgccgcggttggccaggccaggctcatgatggtctatcaaaagctgtttgccgaatataaccagacggcggcccagatattaatgacgaaaaatacagtgacaaatccacagtcccgttttaatgcgcacaacacatttaacgagctgctgaagctggggactatccccattgtcaatgaaaatgatacggtcgcaaccgatgaaatccagttcggcgacaacgaccggctttccgctattgtggcggctctggtggaagccgatatcctgatcctgatgtcggatatcgacggtctctacaccgatgacccgaacaaaaacccggatgctgcattcataccgcttgtcagagagctgacaccggaactgcaggcgatgggaaagggagcctcgagcagtgtgggaaccggaggaatgtctgccaaactggcggcagcccagattgccaccggaagcggttcagatatgctgattgccaacgcctgcgacttaaatgttatttacaggattctggagggggaagagtgcggaactctttttaccgcccacgaaaataaagatttcgatctgaatacatatctgaacagtgaaagctgaaaacactgccggagttcagacaggaaaggacagattaaataatgaatcaggataaaattgaccgaatcaatacactctaccacaagagccagtcagtcggccttacggaagaggagaaggaggagcagaaattgctccgcaaagaatatatagaagcaatccgcagaaatatgcgcggaacgttaaacaatatttcaatcaaggagaaagacggtactatcaccgacttaggtaaaaaatatgggaatatcagtgacatccaaagctgaccttagaaaaaaggttctggagcttagaaaaaatctgacggaagaagagacggccggctgggatcaggcaatctgccaaaagattaagaatctcgggttggaaaaacagtatggtactatttactgttatatcagcgttcgcggtgagacaggtacggaagcgttaatccgctggtatctggagcagggactcaaagtagcggttccgcgcgtaaaaggcagggagatggctttttactatattgactgttttgaagatctggagccgggctgcttcggaattcccgaaccgaaaaaaagctgtatgacggcagaggaaacagacgcacccgtcattgtgccgggagtcgcattttcggaacgctttgaaagaaccggctacggagcaggttattatgaccgtttctttgaaaaggaaccgcagcacagaaagatcgcaatctgttatgatttccagattgcagaggctatagcagtggatcagtatgatgtattaatggatcagattatcactcccggaagggaactgagcagattgtagaaaggagaggtacatatgcttgaggttattggcaaacaggcaaaggacgcttccagaaagctggcagttctcggctcagtcagaaagaatgaagggctgagggccgcggcagaagctcttcttgagggggaagaactcattctggccgccaatctgaaagatatcaggaaagcagagcaaacgggaatgaatccggggatgatagaccgtctgaccctgactcatgaacgtcttgcagctatcatcgagggtgtaagacaggtaatcggccttgacgatccggtcggcgaggttctgggcatgaaagaaagaccaaacggcctgttgatcggtcagaagcgcgtaccgatgggcgtcatcggcatgatctacgaagccaggcccaatgtcaccgtggatgcctttgccctctgttttaaagcgggcaatgccgtaatcctgaagggaggaagcgacgcgctggaatccaataaggaaatcgtaaggtggctcagaaaagggcttgaaaattgcggtctgccggcggactgcgtacagctgattacagatacggatcgcgaagtgacaaagcagtttatgaggatgaacggttatattgatgttcttattccgagaggcggggccggcttaatccgcaccgtggtggagaacagcaccgtcccggttattgagacaggaacaggaaactgccatatctatgtggacgaaactgccgactttgatatggccctggatatcattttcaatgccaagacacagcgaatcagcgtctgcaattcctgtgaatcactgctgatacaccgcaaaatagcaaaagacttcctgccgcttctgaaaaagcggctggatgaaaagcaggtggaaatccgcgccgatcaggagtccgcagctatagtacctgactttaaaacagccacagaagaagactggggaatggaatatctggactatattctgtccgtaaaacaggtagactccgtggaggatgccatcgaacatataaaccggtataatacaggtcattccgaagcaatcattacaaaagattacgacagctccagaaaattcctggatggtgttgatgcggccgccgtatatgtcaatgcttcgacacgctttaccgatggttttgaattcggcttcggcgccgagattggaatcagcacccagaagcttcacgcaagagggccgatgggcctgaaagagttgacgacgacgaaatatattatttatggcagcgggcaggtgcggccttaactggaggatttagttgagaatggaggatttagttgagaatggaggacgcgtccggaacggatcgggtcaggtgtggtgagattggtttttctgggtcttccgccccccatggaggttggtcgtggagggggaatccggccggaatgaattgctgcggggaccgtttgcactctttggagtgcgcatcagtgctaagctcgtaagggacctcgctaagcaccggcggactcccatgtcccctccgcaattgattccgcctacttcccctggtccatgttttcgcaggggacggaagactcaggcaaaggttttcgcggcacctgacccggtccgctccggacgctgattgtctccagtctcaaagggggaggaaaccttacaccaaaccacaataaattgagcggaattaaatccggtgatattcttccgggcttaattccgctcaatctgtttaaatatcaattgtatcaaatttccaacaaatatactaatacaactactttagcccatatccaacatatatctaatgcttttggatgtgctgagcggccgcgacaaggtccgcccccgcacttaacgcgtgagacactcagcggccgcaggccagtggacggggccgatacacccggcggagtctttcgtcccggcgaaaaccttcctttggggcggaggagaagatatagtctgcggacgcctttggaatccatcgctgatttgcgaggtcctgtcgagcttagcagcgtgatgcattccaccgagtgaaaacgtgctccgcagactatatcttctccgcagcccaaaaccacaacaatcttccccaggggacgaaagactcataaaaccacctcaccaccccgtccgccgtccgtaccggcggcgtcctcacctgcttattccaatctataaaacatagcctcatcgaataaagccgccagctcagcctggtcgccgtactcaaatccgattctcccctcatatgccatggaatcacaggaatccgtcgccacgtagattcgaagcgtcctgccatcctccctcaggaaatcgattgttgccgcataaggacacttggaaaagccgtacacattggtatcgtttatcgcccggtccatcatctttgacaaggtattaagcttttccctgtcttcgattgtctgcgttctcacctcctgggtgaatgtctcatcaccgctgcccgacggaatcaaaaattcaggaaatgtcattgcggcgctctttaatggtgttttaaaccaatccggatcaaagtccctgtaatcagtcccaacgacattctgtatttccgccattacaagccggtaaagttcttcattcctctgaagggctataaattcattatcgtttttggaatggactatcatataacccggagtatcatgattcccaaaaaactcatattcccggtcatccagaatcagacttgcaccggtgggcaaaagagagcggtccattttgcgcagacgcgtccaggcctcctgacgtgtggcaataccggactctgtctccgaggaagacagcagtccgcggattatttccgctttttcatcatctaaggaaatctggcagggatatggttctgaataaaattccaccgtgtcatcgttctggtaatagaaccagaccgaaggactgtttccatcgtaaaatgaaaggcccggtttacttttcaggaagtcaagcgccgcccttccgttttcattgaatgcatattgaaaagacggatgagccgtacttcctgatgctcccgacaatccaaaacaaaagctgtccagcgtatcatatccgaacggcatgtctaaaaatgtatatccgcccaggcggtagagaagaatttccgtaccatccccgttgtaataaccaattctcagctcttcaccatccgtatcaggtcccgaataattggcaatgctgacattcttaaaatcatcgtaaaccggcgcatcctcacgccggaccgcaatataatactccatctttccgccgtcggtccgtcccgtaacatcataatgtcccagaagcagatccgacagcttctttgtcctgctttcttccaccggccggaaaacggcatcgtcaatatagcgttccacgagggaaatatattcatcctgcaaacggagagccgttacttcctctgtttcctctgtttcgcctccaaccggcacagcagggacggagacggcgggttccctgctcgcagagggcggttttgcgcatgcggatagggcagccatagctccaaacaggattgcgcagtataattttttcataaaagatacctttctgaatactatgctgaccgtttatacgtttgacgggcacagatgtcagaccttccatattttagttcttctgtcaacaacttcataattacgatatcataaatggaacaggagtttcaattaacaatctcttaagagttattaccttttttgcgattcaccggtcccctcattattcggcggtactgtgaatgtttttgtcattatatgccggtagtggaagctgcttcctcattttccagcaaaaacagcccttcagtgggggaattgtagtaaaaatgtaagatagagggaaaattcgtaaaagaaatgcacttgataaattcattccattatagtaatattaactaatgtatgaaaacgatggaagatgtaaggagaaatacatattttatgacttcaatagattacgagacaatcgacctgtccggcctgccccctgagacggagcctgccagacaacaatatttcattgccaggtgcagacaatgggtcacagaaaagagcgaagagctgggaagaccgatgacctgttttatctcaaccttcggatgccagatgaacgcccatgattcggaaaagctgatgggaatcctcctggaagccggatttacggaggggcagagcgaggaatccgactttgttctttataatacctgcacagtccgcgagaatgcaaatcagcgtgtttacggacggctgggctatctgaacagcctgaaaaagaagaatccccatatgataatcagtctctgcggctgcatgatgcaggagcctgaagtggtggagaagcttaagaagagttaccgctttgtcgatattattttcggcacccataatatatataagctggccgaacttctctcagagagaattgatggcaggaaaatggtaattgatatctggaaggataccgcgaaaattgtcgaggatcttccgtccgaacggaaatacccgtttaaatcgggggttaatatcatgtttggctgcaacaatttctgcagctactgtatcgttccttatgtcagaggacgggagcggagccgtaatccggaggatatcatacgtgagatagaagcgctggttgcaagcggtgtcgtagagattatgcttctcggccagaatgtcaattcttacggaaagaatctggaaaagcccatcacctttgcagagctgctacagcagatcgagcagattgaaggacttgagcggatccggtttatgacatcccaccccaaggatttgtcggacgagctgatagaagtgatgaaacattcacgcaagatttgccgccatctgcacctcccgcttcagtcgggcagcagcagaatattgaatctgatgaatcggaagtatacaaaagaacaatatctgacgctggccgcgaaaattaaagaggcgataccggatatatccctgaccaccgatattattgtcggttttccgggggagacggaggaagattttgaggaaaccatggacgtggttcagagagtccgctatgacagcgccttcacctttatctactccaaacgtaccggcacgccggccgcctccatggaggatcaggttccggaagatgtggtaaaggagcggtttgaccgtcttctcaaagaagtgcaggcgatctctgcccaggtttgcggcagggaagtccacaccgtacaggaggtactggtggaggaaccggatgatcatgaggaaggttttcttacaggaaggctttccaataacaccatcgtgcacttccccggaagcagagagcttatcgggaaaattgtcaaagtataccttgagcagtccaaaggcttttactacatgggcaggcagcttgacgccgcccgggactctcttaaggataaataaggaggaaattttctatgaaaaagcactacaagggtcttgctgttgccttgtcggcggtaatgctggccggcggaagttttacagcatatgcaggacctgcaagtgaagccggctcaccggccgcaccatcaggcaattcaggcgatagcggttttggtccgggcggcacaactgccgcagggcaccagcagcaacagtctgacacagaacaggcagcggtggaggatacctctcttcatgtagcagtaaattatacgtttgagtctgccggagatatcacggctttctccatggacttgaagaattttgacggaatcggaggagtgtcctaccgtgcctacacgaatacaggaggattcctgtggtggtatcatgacggaggcctgacaggcgttcccggagacggcaactatgtagaggcattccagatccagctgaccggagatgccgagcgtctttatgacgtctactacagcgccacatcaacaggccagggtaagatgggctgggcgatgaacggtcagattgccggaaccagcgatatcggtgagaagcttctcgatatcgaagtggtacttgttccgaaaggagcccagggaccggtgagcgatgctcccagatatgtgactccgctttcaggccgccttgtcctcgcagaaaatgcgacaacactcgtcaatgaggatggaacgggctacaacggatgggtatccaacgaccatgcccgctattatttcatcgacggacatgcgcttacaggatggcagtatgtagacggctataagttctactttgattcctacggccgccttgtacagaatgtggagccgttaatcggcaaacagagcagctatcttttgaaggtaaataaaaccctcaactgcctgaccgtctatgcaaaggatgggaataacggctatattcttccggtaaaggctatgctgacctcggtgggagacgatacgccaatcggaaccttctatactcctgagaaataccgctggagactgatggtaaacgatacttatacgcagtatgcaacaagaatcactcagggcttcctgttacattccattacatatgaggagcctgatattaacaagctgatgacagttggatacaatggtctgggagttaccagatcgctcggctgcgtacgcttaacgtgtgagaactccaaatggatctatgataactgtgctctcggcacagcggttacgatttatgaagatccaaatgtagcctccccgttcgacgtgcctgagctggttccgctctccttcgagcagacatgggatccgactgacccactgattgtgagataagagaagagaggtaaaacgtggcacagctttcaccaatgatgacccagtatctggagactaagaaacaatatcccgactgtattctgttttacagactcggagatttttatgagatgttctttgaggatgccttaacggcatcccgggaactggaaattacattaactggaaaagactgtggacttgaggaacgcgcacctatgtgtggcgttccttatcacgcgcttgaaggttatttgagtaaactggtccagaagggctacaaggtggcaatcggagagcaggtggaggatccgaagacggcaaaaggtcttgtgaagagagaggtaatccgggtcgttacgccgggtaccattaccaattcccaggctttggaggagtcgaagaataattacctgatgggaatcgtttatacggacggaatattcggaatctccgtggccgatgtcagcaccggcgattaccttgtcaccgaagtcaaatcagagcgcaatctgattgatgaaatctacaaattttcaccttctgagatcatatgcaatgaagcattttatatgtcgggaatcgatttagatgatttgaagaacagacttcacgctgtaatttcagatctggataatcggttcttttctgatgaattctgcagaaaacttctgcgggatcattttcatgtagagaatctggaaggccttggactttcagactatgagaccggcaccattgccgccggtgccgtgcttcagtatctctatgagacgcagaaaaattcactggagcacctgaccagaatcaccccctatacaaccggccagtttatgatgctcgacacctccacaaggcgtaacctggagctgattgagacgctccgtgaaaagcagaagagggggaccctgctctgggtgctggacaagacaaagacggcgatgggagccaggatgctccgttcctttgtggaacagccgctgattcataaagaagagattttaaaacggcagaatgccatcgaagagctgaatatgaattatatctcccgggaggaaatctgtgagtatttgaatccaatctacgatttggagagacttctgggacgcatcagctataagacggccaatcccagagatctgatatcctttagaaattccctcgagatgctgccgcacattaaacatattttaaaagagttccgttcagagctgctcacagagattgaaggacagcttgatccgctggaggatttaaaaaagctgattgacgaagccattatcgacgatccgcctgtttctgtcagggacggcggcattataaaggacggctttcatgaggaggcggaccggctgcgccatgccaaaacagaaggaaagacatggcttgccgaactggagcagaaggagaaggagagcaccggtattaaaaacctgaaaatcaaatataacaaggtgtttggttattattttgaggttacaaactccttcaaagatctggttcccgattattttatccggaaacagacgcttaccaatgcggagcgttatacaaccgaccgtttaaaagagcttgaggatgtgattatgggggcggaggacaagctgttctcccttgaatacgaattattctgccaggtcagggacggtatcgccgcagaggtaaaacggatccaggagacggcccatgccgtcgccctcaccgatgtgctgacttccctctccgtggtggctgtaaggaataattacgttaagccttccatcaatgaaaaggggattatccatattaaaaacggccgccatccggtggtggagcagatgatgtccggaggaatgttcgtggcgaacgacacttatctggataacggaaaaaacagggtatccatcattacaggccccaatatggccggaaaatccacttatatgagacagactgcgctcatcacgctgatggcccaggtgggcagttttgtaccggcggatgaggctgatatcggcctgtgcgatcggatatttacccgtgtcggcgcatccgatgatctggcttcgggccagagtaccttcatggtggagatgactgaggttgccaatatcttaagaaacgcaacccgcagcagcctgctgattctcgatgaaatcgggcggggaaccagcacctttgacggtctttccattgcctgggctgttgtggagtacataagcaacacaaagcttctgggtgcgaagacactctttgccacccactatcatgaactgacggagctggaaggcactatgagcggtgtcaacaactactgtatcgccgtcaaggaacagggagacgacatcgtattcttacgtaaaatcgtaaaaggcggtgccgataagagctacggaatccaggtcgcaaagctggcaggtgttccggagcttgtaatcgaacgggccaaggaactggtggaggagctgagtgatgctgatatcaccgcccgggccaaggaaatcgcggaaaacggccccggcattgtggcgcacaaaaaactcagcaaaccggatgaagtggatctgcttcagatgtccatcttcgatacggtcagcgaggaggacattataaaagaactgatggaactggaaatcaaccgcatgtcccccatagacgccctgaccacgctggataagatgcagtcccgtctgaggaaccggtgggttaaccagtaagtataaggaggcgaaacgatggcaaacattcaagtattagatcagaatacgatcaaccagatcgcagccggtgaggtaattgaacgccccgcctccgttgtgaaggagctgctggagaacgctgtcgatgccaaatccacggcggttacggtggaaatccgtgacggagggctctccatgatccgcgtgacggataacggctgcggaatcccgaaagaagaaattccgcttgcctttctgcgccatgcgaccagtaaaatcaggacggtcgaggatttgttcaccgtagcctccctggggtttcgcggagaggctttatccagtatcgcctccgtggcccaggtggagcttatcacaaaaaccacagggagcatgtcaggttccagatatcagattgagggcggagaggagatagcgttagaagaggtgggggctccggaagggaccacctttatcgcgagaaatctcttctataatacgccggcccggaggaaattcttaaagactccgatgacggaaggcgcccatgtggcggatttggtggaaaagattgccctttcccatccggaaatctccatacggctgattcagaacggacagagtaagcttcatacatccggcaaccataacctgaaggatatcatttatactatatttggacgggagattgccgccaacctgattgcggtgcagtcgggggccgatccggtgaaagtcgaaggctttatcggcaagccgctgattgcaagaggcaaccggaactatgaaaattattttataaacggacggtatattaagagcagtctgataaataaagcaattgaggacgcctataaaccgttcatgatgcagcacaaatacccgtttacaatgctgcagtttacaattgagccggaatttctggacgtgaatgtccatccggccaagatggagctgcgtttcagggacggagagatggtctacagaatggtgtaccatacgatttctatggccctctcccaaaaggagctgattccccaggtggaactgccgggaggcggccaggagagcgccaatgcgcaggccaggggcctgaagccggttgtaattaaggaaaaccggcctgagccttttgaaaaacgcaggctccagacggaatcactgattaagtctgcggccacgtcagagctttcgggagaaccggagacctccgcttataccgaacgtgtgtcaaagactgcttttccggccattgccgacatgcctgccgtttacggccggcagcctgcttcggcaggcatggcagatgccgcagaacagccggaaactcttcgaatgccggaaactccaaaggcgccggaagcccccgggcctttggagttcccggagcagtacaggccggtaccggcagaaggaaaaacacagaatccggcaggggccaaagagatacttccaaagcaggagccgccgaagcagttagatctctttgaagaaaagctgctgacaaaacaggcaagaaatgaacatgttctgatcggccagctttttgacacttactggctggttcagtttcatgataacctttatatcatcgaccagcatgcggcccatgagaaggtactttatgaaaaaaccatggcctcgcttaaaaaacgggaatacacctcccagatgatcaatcctcccatcatcctgactctgtcgggaaatgaagagctgatgctgaaaaaatacatggaacattttacagcggttggttttgagatagaacatttcggcggtaaggaatatgcagtgcgggccgttccggccaatctgttctctattgccaagaaggagctactgatggagatgatagacggcctgaccgacggcgtcgatcagggaacgccggacataattaatgaaaaaatagcatccatgtcatgcaaggcagcggtaaaaggcaatcatgcaatgtcggccgctgaagcagacagtctgattgacgaactgctggagctggaaaatccgtatgcctgcccccatggaaggccgacgataattacaatgagtaaatatgagctggagaaaaaattcaaacgaatcgtataggaagtttacataatttaattatgtaaactatataacggttttcaactcggaagcagcaccgcatatgcaggaataatagcaaggacaatagcaggaacaatatatgaagaaacctataatcataataacaggccctacggccgtaggaaaaacctccctctccatcggccttgccaaacgcattgggggagagattatcagcgctgattccatgcaggtttacaggcatatggatatcgggtccgcaaaagccacaaaagaagagatggatggaattccccatcatctgattgatatactggagccttcctgcgactttaatgtcgtcatgtttcagaaaaaggccagggaagctctggaggatatctattcccgcggttccctgccgattattgccggaggcaccggcttttatatacaggctcttctctacgacatcgattttacggagacagaggaggacaacgctttccgctgcgggatggaacggctggcccgtgaaaaaggtcccggctttctccatgccatgcttaaacaggcggatccggaatcagctgccgcgattcatccgaataatattaaaagggtcatccgagcactggaataccatcatcagacaggagagaagatatcggatcataacgaggctgaacggcagaaggaatcaccctatcagtttttctattatgtcgtaaataccgaccgggcgattctttatgaacggattgaccgccgcgtggatcagatgatccgggacggactgatagaagaggtgaaatctctcagggccatgggctgcaccagacagatggtatccatgcagggacttggctataaagagattatggattatctggatggtttgtacagccttgaggaggccatccatattctgaagcgtgatacaagacattttgcaaagcgccagcttacctggtttaaaagagaacgctgcgtgcgctggctgaacctgcctgattttgataatgacagggaaaaagtgcttgaatatataatcgcggagttcaatcaggagacgcagacagcacatcactgaattttaccgttatgaaaggaaatgaaaaatggaattggaagagatatacaaaaaccttggaatcagccgggaagtacttgaattcggcagcaggaccgaggctatgctgaaaacgcgcttcgaggaaatcgacagcaatgcggaatataaccagttgaaggtgattgctgcaatgcagaaaaaccgggtcagcgacattcatttttccggtacgacgggatatggatataatgatctcggccgggagacactggaacaggtgtacgcagacgtgttccacacagaggatgccctggtacgcccgcagattacctgcggaacacatgcgctttatacggccctggccggcaatctgcgcccgggtgatgaacttctgtcaccagtaggaaaaccatacgacacgctggaggaagtcatcggcatcaggccgtcgaacggttcactgaaagaatatgggattacgtaccgtcaggtagacctcctcggggacggaagctttgattttgacgggattaaagccgccgttaacgagaaaacaaagcttgtgaccatacagcgttccaaaggatatgccaccaggccgactctctcggtgaagagaattgccgagctgatcgcctttgtcaaaggaatcagggcggatatcatctgtatggtggacaactgctacggcgaatttgtagagcgtatcgagccgagtgacgtgggcgccgatatggtggtcggctccctgattaaaaatccgggcggcggccttgctcccatcggaggctatattgccggaacaaaaaaatgcattgaaaacgccgcctaccgtctcggctcccccggactcggaagagaagtgggggccagccttggtgtcaatcaggctctgttccagggactgtttctggccccgaccgtggtggcgggagctttaaagggagccgtatttgcggcaaatatctatgaagcccttggtttccaggtcgtaccgaacggaaccgaatcacgccacgatataatccaggccgtcacctttggaaaaccggaaggcgttatcgcattctgccagggaatccaggcggccgccccggtggacagttatgtgacacccgagccctgggacatgcctggctatgattcccaggtcattatggcggccggggcattcatccagggctcttcaatagaattgtctgccgacgggcccatcaagcctccctattccgtgtttttccagggcggactgacttggtaccatgcaaagcttgggattcttatgtcgctccagaagctgctggatgccggtctggcaaggctaacctgatcatggagatttaactgaggttgggaggacgcgtccggaacggaccatgtccggtgtggtggggggactagctgagtcttccgtccccggggggaggttgtcgtgaggggggaatccggccggaatgaattgctgcggggaccgtttgcactctttggagtgcgcatcggtgctaagctcgtgagggacctcgctaagcaccggcggactcccatgtcccctccgcaattgattccgcctacttccctggtccaggttatcgccggggacggaagactcaggcgaaggttttcgcagcaccggacatggtccgttccggccgctgattgtctccaaccttaaatggggagggccctgtcgcggccactgcgtgtttccggcaggccgatatcaaatcctccacaattttttataaaaggtgtattgatggcatatcgtatttcccgtacacggtagcactgagtggcctcgacaaggtccgcccgcacttaacgcgtgagacactcagcggccgcaggccagcggacggggccgatacacccggcggagtctttcgtcccggcgaaaaccttccgggagaaggagatactgccgacatcttccggcggagaaggagagaatgatatccggaaggacgttcgcccgagagatgatagctcttaggcagagggagacaaaacgcgccgggcggattttagccctacaagggcaaaatccgggacaacttgagcttcgaactcattcggagttcggagtgaatttgtccgtaaccccggggggctttgccttcctctgtcttagagctatccctcgaagaagcagtccagccggatatcattctctccggctccgccctgcgaaaacaaaaccacagtatctccttctccatccagcgatgccaaacccccgggacgaaagactcatatacacaccccaccaccccgtccgctggccgtaccggcggcgtcctcacctgcttaactaaatctccatatgttttagcaacagccccccgtctgagctgttaccgtttaataaatctttaataaaaaactcagcctcctgatgtatacaggcaggccggtttatgctacaataaaaagaatcggtgtaatgccccataaatggaaatcattactaaccgggatacaagggagagaacaaacagaaatgagcagagcgaaaaacttctggatcctgctgctgtttttactgacaggaattgtacttggcggttttatcgggaacctggcttccgatataccgtggctgacctggctgaatttcggagaaacctttggactgaccgagccggttgtcctcaatttcggaattcttgttattaccttcggtcttacaatcagaatcacgatggcgagtattgtcggagtgattattgcagtcattacatatcgtctggtctgaagctgagacagcgcggctgaaagccaaactgcttcattgatggcggtggcctgtgcgcggagcgtgcggattatcgttccatatccttacactgtacttggagaggcacggtgaggaggagtagtgaaaagacgtacgatgaaagaactgccctattcggacagaccttatgaaaaatgtctggcatcggggccggagagcctgacggatgccgagcttttgtcggttattttaagaaccggcgcaagaggtgaaagttctctggagctttcaaaacaaattctggaactcagctatcccgcagggattctgggacttcttcatctttccctgccagaactgatggcagtcagggggattggcaaggtaaaaggaattgaattactgtgtatcggtgaattatcccggcgtatctggagaacactggtcacggaagaggcggtggttttcaacgaaccggccgttatttccggcttctatatgcaggatatgcgccatatggagcaggaagaactgcatctaatgatgctgaatacgaaaaatgtactgattaaggattctctgattttccggggaaccgtcaatatgtcggttgcctctcccagagagatgtttatcgaggcgctgcgctatcacgcagtccatattatcctggtccacaaccatcccagcggagacccttcccccagcagtgaagacaaaaagctgactgctcaggtaaaagaagcgggggctcttcttggtatccggctactggatcatattattatcggggataattcttatttcagttttaaagaacggggaattatatagctatgaagaacagcaaatatatcctggcagggctgtctgttttctgtgtcctgctgattgccgtaacatccattaacagcagctttcttacgccgctgcgtaccggtgtcggatacttccttgtaccgctccagtcgggtatgaataccgttggtacaagcctttacaacaatatcagggactattcctccctgaaggaggcgcaggcggagaatgcaaggctcacgcagcgtattgatcagctgactgaggagaataaccggcttcaggcagaacagtttgagctggaacgcttaagggagctttaccagcttgatcaggactatatgcagtatgagaaggtggcggcccgcgttatcgccaaagactccggcaactggttccagattttccggattgacaaaggctcggccgatggaatcaaagttaatatgaatgtcatggccggcggcggactggtgggaattgtcaccgatgtgggggcgaattacgccacggtcagggccattatcgacgacgacagcaatgtcagcggaatgtccatgcgttccggggatacctgcaacgtatccggtaatctgaccttgtatcaggaaggacgtctcggccttgatcacatcaaaaaggactatgacatccagaacggcgacaagattatcacatccaatatcagtgatatctttcttcccggtcttttgattggctatgccgccgatttgtccaccgatgccaacaatgttacgaaatcaggtttcatcattcctgtagcggaatttgacaacctgcaggaagtactggttatcacccagcttaaaaacgggggagaagaagatgcgcaaagtactgattaatattatacttctgatcctggcatttacgatccagatatgtgtgtttcctcagatcgcctttctgtcttcggcgccgaaccttcttctcatttccgtatttatatgcgggttcattgagggcaaggaggccggcatgttttacggcctgatagccgggcttttcatggatcttttttacagcggtccttttggcttttataccctgttttacatcaatatgggatacctgaacggaatctgcacaaagtactattatgaggactatattacactgcctcttgtgctgagcatcgtcaatgatctggcatacaatatgtatatttatatattccgtttcctgatcagaaacaggctgaatttcggccattactttattaaaatcatgattccggaaatcatatttacaaccgtaaccaccctgattgtttaccgtttctttctttttatataccgtaagctgaaggcgtgggagcaaaggagagacaagaatcttgtttgatgacctgaaagaatttttaaaagaattaatcaaaaaagtggttacctcccgtcttttcgccctttccgcagtcttttttattatgttctgtgtgctggtcggcaggctttttaagctgcagatcgtcgagggagaagagtatcaggatgcctatatagccctggctgaaaaagtcattaagacagacagcacaaggggcaatatttacgacagaaacgggaatgtgctggcttacaatgagcttgccaattccgttaccatacaggatatcggagccttccgcaaggcgagccagttcgattcggactggaacaggatgctttacgagctggtgtcgattctgaacaaacacggtgaaaccgcccagggaagcctagaacttatgatagaccacaacggtgaattggcctattcaacaaagtcggaggctgccagaaagcggtttttaagagatctatacggtaagaaaagcgttgatgaactgactgataaggatggcgatgctccggcagacgttacggcagaagaactgttcgataagctgaaagtacagtacaagcttgatgaaacgaaggataagaagggcaatctcattgaaattccggatgaggtcgcgcttcagattatcaatatccgttacaccatgcggttcactgcttatcagaaatacgaaacgaccaccatcgctaccaacatcagcgatgagacggtggctgatatactggaacactcggcggatcttccgggggtcgatatcgaggaatccacaaaccgggtatataacgaaagcttgtattttgcaccgattatcggctataccggaaaggttaccacggagcgtctggaggaactgaagcaggtgaatgacgactatgagttaaacgatgtcgttggcagaaccggtattgagtcttccatggaactggagctgaagggacaaaaaggctcccagaccgcttatgtggataatgtgggaagaatactgacgataacagatgaggtacagcccgtggcgggcaatgatatctggctgactctggatttaaaccttcagaaggccatctataacatactggagagacagctggccggtgttcttctgaaaacaattgtaaacaaagaggctgacgaaatcgtctatacggactcgtcaaatatcaagcttcccattaaggatgcctatttccagcttattaataacaacgtactctccctggaacagtttgcgtcggacgaagcctctgatgtggagcgccagattaatgcaaaatatctgaacgccagagccaggattgaaaacgacatacgaagcgagctgttatccgggaacgccactctgatgcgtgatctttcggaggagatgcaggcgtatatgatttatatttatacctacctctccagtgatgaggccggagtcattatcaaggattccatcgacacgaaaagcgcagagtatcaggcatggaaaaacaatgccatcagcctccgggattatctctattacggtattgccagcaactggatagatacgacgaaactgaacatcaccagtaagtattccaatgccgacgatgttttctccgccctggtggattatgtgttccagaatctggccgatgatacggagtttacaaagaagatttaccgctacctgatcaataacaacgtggtttccggcaaagagctgtgcctcgccctgtattcccagaatgttctggcctacgacgaggcggaggttaaccgcctccgtgccagcggggatgattatgcgtttgaatttctgatgaacaaaatcagaaatattgagattacacccgcccagcttgcactcgatccatgtacggccagttgtgttgttaccaatgtcagaacaggggaggttatggctctggtcacatacccgagctatgacaacaaccggatttccgacccggaatattttgcccagctcaatgccgatcagtcgctgccgctgcgaaacaacgcaacccagacgctgaaggctcccggttccacctttaagcctatcacggccattgccggactggaggaaggggcaatccggattgatgagaccatcaactgtaccggtgaatacgaggaggccaatccgccgatcaaatgctggaaatatccgggcttccacggccctttgaatgtaatcggcggtatagagaattcctgtaactactttttctccgaactggcacacaggctgtcgctggatgcggatggaaattacaatccggataaaggtttggaggtactcagaaaatacgccacaatgttcggcctggaccagccgtccgggatcgaaatttatgaggccaatccggagattaccaacaaggacccggagcgttccgccatggggcagggtacgcataactatgccaacgtacagctggcccgctatgtaacggcgctggccaacagaggaacggtatttgatttaagcctgatcgacaaggagaccgattcccagggcaacctggttaaggattatacgccggcggtccatgcccagctcgatatcgcccagtccacatgggacgcggtgcagcagggtatgagacaggttatcacaaacagcagtacaaagaaaattttcaataacctggatgtcagcattgccggtaagacaggtacggcacaggagtcggacaagagaggaaaccatgcatttttcgtttccttcgcgccttatgagaaccctgagattgccgtcaccgtcaacattccgaacggttattcctcatccaatgccgcaatggtggcaaaacacgtataccgttactactacaactataccacacttgataatatcatgacctccggagcgctggacgcatccaatgagaggattaacggagactaagaggtgagtgtttcatgcaaagttccgtagttatcaagggcagcaaggccggaatgacggtcatactgaatccggatgtgccctttgagcagctaatagaagacataggaaaaaaattcagggagagttcccggttctggggttccattcagatgactctgaccctggaggggcgtacacttacaccttctgaggaatttcagattgtggatgccatcacggccaattcacagattgatatcctctgtatcctggataccgatgccaaccgcatcgccaaatgtgagaaggccctgaccgaacgcctgatggagctttcctcccagacagggcagttctataagggcagcctgcagaaaggcgatgtgctggagtcggaggccagtatcgtgattatcggcgatgtctgccacggcgcacgcgtcatcgcgaagggcaatgtgattgtactgggagtgttaaatggtacggtccatgccggagctgccgggggcaacgccgtgatcgtcgcattcgatatggctcccacacagcttcgtattgccgattactgtaccagggcagaggaaaaaggaaagcggctcggccggggacctatcattgtttcagtggaagaagacagtctggttgtccggccaattaaaaagagtttcttaaattatttaaattttatttaatactggaaatatttctgattttagagtagaataatagggtaaactgaatacaggaggatgttcaaatgagtgaagtcattgttgttacttccggaaaaggaggcgtcggcaagacaacgacttccgcgaatgtcggaacaggccttgccatgctgggaaagagagtcgtattaatcgataccgatatagggctcagaaacctggatgtggtcatgggactggagaaccggattgtatataatctggtggacgtagtggaaggcaattgtcgcatgaagcaggcgcttattagagacaaaagatatcctaacctgtttttactgccgtcggcacagacgagggacaagtcaagtgtcaacccgtcgcagatggtaaagttagtagagtacctgaaagaagattttgattacatactattagattgcccggccggtatcgaacagggatttaagaatgccgtcgccggagcagacagagcacttgtcgtcaccacgccggaggtatccgccatccgcgatgcagaccgtatcatcggccttctggaagccgatgccaccaaacgtattgaactgatcatcaacaggatacgaatggatatggtacaccgcggagacatgatgtcggtcgatgatgtgatggatatcttgtccatccctgtcatcggaaccgtgccggatgatgaggacatcgtcatttccaccaatcagggtgagcctctggtgggaatgaacggatatgccggtcaggcctatctgaacatttgcaaaagaatacttggtgagtcggtaccgtttatgaatctggaaaacagccggaatatatggtccagaataacctgtctgcttaagcgggcttaagggagggactgtatgatgcatttagtggagctgtttggccggaagaattcaggcgaaatcgcaaggcagcgcctaaaactattgctggtttctgatcgggcaggctgctcgccggaactgctggagatgatacgcagtgactttatccacgccgtctccaggtatatggaagtggatacaaacgatctcaccgtatgcgtcatcaggagttcaactgatgaatacaagggaaaagtacctgcgctgtatgccagcataccgattcgcgacttacagaataaggggccatttacagcatgatattcgattacaactttaaaaattacaatttccgcataattttttatatgctggctctcagtacactcggtgttctcgtggttgccagcgccagcggacaggaccgggcgactgtactcaagcagatcgtcggggtagcgatagcactggtcatatgcatcgtcatttccctgattgattatcacaagtattttaaattcagctccattatatatgtgggctgcgtttccctgctgcttgccgtactgttaatcggaaaaaatacaaaaggagcaaccagatggctgcgaatcggcggtatacagatccagccctctgagtttgtgaaaatagggcttattgtgatcctttcctggtttctgtcaaagaatcaggaaaggatcaatgcgccgtccgttgtcggaacggcagcgctgatgtgcgccgttcctctcggaatggtctatatgcagccgaacctgtccaccaccatcgttattgcttttacgcttgtctgcattgtgtatgccgcagggctcagttataaatggattgtgggagtactggctgccggaatcccgcttacgggactctgtctctacctggccctgtttgatatggtaccgttccttaagaagtatcaggcacagcggattctggcgaaaatatttcacagtgacagccagtatgccgatttaaaccggcagcaggataattccattatggccatcggctcaggacaactaaatggcaaggggttatttaacaataccctgagttctgtcaaaaacggaaatttcctctcagaggaacagaccgatttcatctttgcggtaatcggggaggaactgggcttcatccgcagtgtcatagtgattcttgtctatgctctgttggtttatgagtgtctttacattgccagccgtgccaaagatacggcaggcagacttatttgtaccggtatggcggctctgcttgcttttcagagcttcgccaacatagctgtggcaacgggaatattccccaatacgggactgccgctgccgtttatcagttccggtatcagttcacttctcagcatgtttatcggtatgggaattgtcttaaatattggacttcaaagaaaaagcagcaatcattaaggaggcaggttatcgatgaatataggattaatcgcacacgattcaaagaaaaaactgatgcagaacttctgcatcgcttacaaagggattttagccaagcattctctttatgcgacaggcacgacgggcaggctgatagaagaggttacaaacctgtccatacacaaatatcttcccggtcatctgggaggatctactcagcttggttcacagatcgagcataattctattgatctcaccatatttttaagggatccgctgtcaccaaagtcacatgaaccggatgctgatattgttatccgtctttgcgatgtacacaatattcctctggccaccaacctagccacggctgagctcctgatcaagtctctggatcgcggcgatatggagtggcgcgagatgtataaatagaggtgcgccattgaaacgtataataatacagagctccgttctgcttgcggcagcagcgctttcactttcagcctgcggtaaaaaaggcgggctggaggaagcttattcatatgaagaacgatcacagctaatgtccgcacatgggggcagtgagctggctcctcttttcgcggaggatctgtgcgtcgtcacagacagtcaggacggggatacatccatgaatgcggaggccggagctctctttaatgttacagaccgctctgttgtctacagtaagaatgcattcgaacggctgtatccggccagcactaccaaagttatgactgccatcatcgccctggaagaggggaatctctcggatcaggtgacggtgacggaggatgcggttataaccgaggcaggcgcttccctctgcggaatcaagccgggagacgtgattacaatgcaggatcttctctacggccttatgatgccgtcgggtaatgatgcggcgaacgccattgccgtacatatgtatggtagcattgacgcgtttgcagacagaatgaatgtcagggccagggaactgggcgccacagggacccactttatgaaccccagcgggcttactgacgagaaccattatactaccgcttatgatctctatctgatgttcaatgaagcgatgaagctcccgcttttcagagagataatcgctgaagattcttacacagccaattatcagaacggcgccggggaagccgtatcgaaaacctggactgtggggaactggtatcagaaaggagagcgtgaaacaccggccggagtcagcgtcctcggcggaaaaaccggaacgactcaggctgcaggatattgcctgattatggcctctaacgacagccaggataaagagtatatttccgttgtccttaaatcagacagtcgtccttccctctatgataatatgacaaatataatttctaaaattgtcaattagtgattgcgctttttatgaatttatactataattatttatagattaaatgactttttatacaacttaaataaaaaatccaaggaggagattgttatggttcagattattgcgggaaataagggtaaaggaaagactaagtatttactggacatggcgaatacagcagtaaaagaatccaagggttcgatagtttatcttgacaaaagtgcaaagcatatgtacgagctgaataataagattcgtctcatcaacgtacaggaatatccgattacttccagtgaaggatttataggttttctttgcggaatcatctgtcaggatcatgatctggaacagatgtatttagacagcttcctcaagctgtcctgcctggagggcgaggatatcgaagcgacctaccggacgctggagactatcagtgaaaaatatcatattacatttgttctcagcatttccatggacgcagatacgttacctgagattgcaagaccaaatgtggttgtttcgttataaatgggtaacttacagtaccttcatacgttaccgcttcgcgatgcgcaaaaacagcggaaaactgtttcgtgccgtatgagcagttacattaatggtacataacttacagaagaaagagtgctgcggccgcggcgctctttcttttgcttgaattttttgacaattactcttataatacaaaggaaaggagaacggcattacatcatggctaaaaacaaaaaagttatccgctataaaaaaccactgaacataaacgttggcatgattatttttgccatgatattcgtttatctttccttcagtgtttacacgtatatccgccgcgataagatacagttctatgaagtggtcgagggcagtatcgtaaatgacaagagccacacagggattattctgagagaggagaccgtcagacaggccgacaggacaggctttgtcaattattacataagggaaggcaaacgcgccgctgcgggcgcccgtgtttattcattggatgaaacaggacagctgggcaaatttctggaggagaaccaggaaaacgccgcccctctctccgatgaaaatctctccgaactgaagaagcagctcagctccttctgcctctcttacagcgacagccgcttcggagctatttatgatgagaaatattcactccaggcctccgtggcggagtatatgaacttcaacgcacttgacggtatggacgagctattaaaggaacggggtattaattaccagcaggtttatgcggatcagcccggtattgtttcttatgcgatagattcctatgaagggatgaccgcctccgatatctccgaggcatcctttgaccgcacactctataaacgctcctttggcaaagcgggagatttaatcgagaacggcacgccggtttacaaactgatcacctcagagaactggtccgttgtgtttcctctcagcgaagaggatcagacggcctatgcagacagaaagacgctacaaatcaagccggcaagcacggatttctcgatgcggggttcctacagccagatcacgggaagcgacggcaagctttacggcaaagtagattttgataagtttatggtacagtttgcttccgaccggtttatcgattttgaaatcgtgtcagatgaggcagccggtctcaagatccctgtttcatccgtaacatcaaaagagttttttacggttccggtcgattatctgactcagggcggagacgccaccatgtcggagtccggcttcttaaaggaagtctattcggaatccggagaatcctccattgtattcacaccggccgatatatataattccacggaagaatattattatgtggataaaagcgattccggaccgtttaaaagcggagattatattgtaaagccggattccagtgagcgttatcagattggtcctgtcgcaacgcttaagggagtctacaatattaacaagggctatgccgtgttccgtctcatatcggagctgacgaataacggtgaatattacataatagaaaaagggacaaaatatggtctttccgtgtatgatcacatcgtgcttaacgcctctacggtaacggaaggacagattatataccaataacgctgggaaaggtgtgtcagaatgatcagagaaaatttaaatgatgtaaaagaaaatattgtttcggcctgccgggcttcgaaccggcagcctcaggatgtaacgctgatagctgtcagtaaaacaaaaccggtggaacttctcagggaggcatatgatgccggcgtccgtgacttcggtgaaaataaggttcaggagattcttgaaaaggcgcccgcacttccggatgacatccgctggcatatgatcggacatctgcaaaagaacaaggtacgccaggtcatcgataaaacagtcctgatccactccgttgatacagtggctctggctgaacagattgaaaaagaggcggccaaaaaaaacattgatgtcgacatccttctggaggtcaatatcggggaagaggaaagcaagtatgggttcagggccggcgaagttctggaggcagttaccattatttccaaattctcccatgtacacataaagggactgatgacaattgctccatttgttgaaaattctgaagaaaatcgcgatatttttctaaaattatatcaattaaatgttgacataaaaagcaaaaacatcgataatgttaatatggctgtgctctcgatgggaatgaccggtgattatatgacagcaatagaagagggcgcaaccatgattagagtcggtaccggaatctttggtgccaggacaaagatgggagagaatttagtatgagtattctgaacaaactaatggatacaatgcgtttaacagaagaagacgatgaagactacttcatcgatgacgactatgaagatgagaaacctgccaaaaagcggttatttaataaaaaagaagaagaagactatgactatgatgaggaaccggagccaaagccccgttttctttcacgttcctcaagcaaagtagtccctatgaggagggggatggaagtgactctaataaaacctacctccatggaggattccagggagatttgcgattatctgctggcaggaaaagctgtcgtcatgaacatggagggcatccatatggaagtggcgcagagaattattgatttcgcatcaggcgccacgtattcgatgaacggaaacctgcagaagatttccaattacatatttattgcaacaccagaaaccgtagaattatccggcgatttcccggagcttttagctgacggctctttgaatatttccggaatgaaccttcacttttaacattattatgcaggataaagacgaacaattactgaaaaagcgtatatcggagctggcggcgctctgctatcagcgtgatatacggtcatataccgattttctgacgttaaatgaacagacaattttccattccatgaaacgtacgcttcctcctgtcacctggctgatgggcggaggttatgagactgccgaacggaaaattgtttgttttctgccgtcttatgaagatgaaacagccgatttatcaatcagtatactggaagccgttccggccagtccacgctttgcagaggctctgacacaccgggattttctgggggccattatgaaccttggaatatcgcgaagctgtattggcgatattctgatgaatgaaaacggctgttttattttttgtctggagaagatggctccctttttaatccaggagcttaagatggtgcgccacacccaggtcagctgccggcccgctacgcaggccctggcggccgctccgaactgcgagacggtgagcggaagcgtggcatctccgcgtctggacagcgtgatttccctcgtttttaagacgtcccggtcaaagaccctcccatttattgagggggagcgggtatttatagacggccgcctgtgcatctctcccggccggcagttaaaggagggagagattatatcggtccgcggcctcggcaagttccgctataccggcgccggaaatcagacaaagaaagggcgccttttcgtcaatgccgaaaaatatatatagtccgcaaatacatgccgaaagttacgattcgttttcgcgccgttaaactcgggattttcactcaaaatacgagtgaaaacacctctcggaatagcggctgtaacagtaactgcccaaatacggataaggagaaacgattatgtatggcaaaaatacatctgagaatactacagacagacttaccgtgcatttgaacggcgagcctgtatacgatattgttatgacacaagattttaacggcctgcaggaggaggtacgcaaacatgtctctgcttccggtaaactctgcattgtcaccgactctacagtgtcggagctttacctgagggaagtggccgaaatcctgtcatcctgctgcagcagcgtgatttcttatgtttttccggcgggagaggcgcataaaaatctgtctactgtccaaaagctctatgaacggctgattctggagcgctttgacaggagtgatatgctggtagccctcgggggcggggtcgtgggcgatctctgcggctttgccgccgccacctatctgcgcggaatttcttttatccagattccaaccaccctgctctcccaggtggacagcagtatcggcggaaaaacaggcgttgatttcgactcttacaaaaatatggtcggcgctttccatatgccgaaactcgtttatacgaatatcagaacccttttaaccctgccggacaacgagtttgccgcagggctgggcgaagtgatcaagcatggcctgatacgggacagggaatactatgactggctgctttcacatgccggtgaaattgaagccagggatctcactgtcctgagacagaccgtcgccggaagcaatttgattaaaagaaaagttgtggaaacggacccgacggaaaagggagacaggatgctcctgaattttggacataccctgggccatgccatcgaaaaactcaaaaattttgaactgcttcacggcgaatgtgtcgccctcggagcgcttgccgccatgcgtctgtccgagagcagaggtatgattacagaagcggaaacagagcgttttaaagaggcattaatgcgatttcatattgcggtgcgtgtttccggcctgacggccggcgatattatcgaggcgacaaagaatgataagaagatggaatccggagtgattaacttcatccttttaaaaagcgtaggctgtgcctatgtggatcggaccgtcacggacggtgagatggaggaagcgcttaagttcatcctgatacaggaggaaatcaatgaataaaaaaatacagcagtttctgttttttctcgccggtctcgttgtcagcatcggcttcgaccagtggacaaagtatctggcagtcgtaaaattaaaaggaaagcagccgtttgtaatctgggatggtgtctttgaactgtattactcggaaaaccgcggggctgcatttggaatgatgcagggcaaacagggatttttctttctgatcgccattgccgtcatagctgttgtggtatttctcctgtttcgtatgccgtctgataaaaaatatctgccgtttaccggatgtctgttcctgctcgtctccggcgccgcaggcaatatgatcgaccgggtggcgaacggctatgtggtggattttttatatttcaaattaatagattttccgatttttaatgtggcagactgttacgtagtgatatccacgctgcttttgattctccttttctttttcgtttattccgacgaggaactggaatttctttcattcggaagacagaagaataaaaaatcggagaatggagaataacaggaaaaggagaatgcagtttgaaacaggaatacattgttccggaaaaaagctccggcctgcgaattgacaaatttctgactgaaagctgtcccgattatacgcgttcctttctccagaagctcttaaaatcagagctggtggaggtgaatggaaaaccggtaaaaagcagctacaaaacagcggccggcgatacggttactttcgaggtgccggaagctgtggaagcggagattacggcgcaggagatgccccttgatatcctctatgaggatgaggatgtgattctgatcaataagcccaaaggcatggtagtacatcctgccgccggacactatgaaggaactcttgtgaacggcctgatgcatcattgccgggagcagctttccggtatcaacggcgtcatgcgccccggcattgtccaccggatcgatatggatactacaggagtccttatcgtatgcaagaacgacctggcccataattccattgcggagcagttaaaggttcattctatcacaaggaaatattatgccgtggtattcggcagtctcaaagacgatgaagggacaattcacgcccctatcggacgtcatccgaatgaccggaaaaagatgagcatcaacagtaaaaacggcaaggatgccgtcacccattataaagtgctggaacgttttcacggatatacactcgtggagtgcaggctcgaaacaggacgcacgcaccagatccgggttcacatggcaagcatcggacatccgcttctgggcgatcaggtatatggcccggcgaaacagcccttccgtttacaggggcagaccctgcatgccggagttctcggtttcctccatccgcgcacaggagagtatatggagttttcagcgccgctgccaaaatattttgaggaactgcttgagaaactgcgccgcttaacttgatacatccgcaatgcagcccgccgctttttggcgggggtgaagagtaacatttctggagggtacaaatgaatatttttgatatactgggtccggttatggtcggcccgtcaagctcccatacagccggtgcggtgcgtatcgggctggcggcgcgcaagcttttgggagaaccgccggtcaaagccgccatcactctgtcaggttctttttcttccaccggagccggccatggaacggacagggcgattgtcgccgggcttcttaacatggagccggatgatatgaaaattcctgaaagcttcagggaggctgaaaaagccgggcttgaattcggttttattcatgatacaatcggcggagcgcatccaaacacggctcttctcgacattttgtccgcgtctggccggaggatccggatgcaggcgtcctcgctcggaggcggccgtatcatgattaacaaactggacggtgtggaaatcaacgtaaccggagagcgtccggtgctgattatccacaatatcgataagcccggctacgtatccgaggttacgtctctgatggcctccggctcggtcaatatcgcaaccatgacgctccaccgcagcaaaaggggcggtgatgccgtgatggtgattgagacggatcagaacatcccggttgaggctgtgaggcaccttgaagccgttaagggcatctttaaggttacctgcctgaatctgtagatattttgtaactgttcatcttatcggaacggatacgatattgtaccccaaacgttactattcacagcctgtatcccgcgaggtgcttccgtgcgtattttgcgcgaaaatcacgagttacacggcgcgaagctgtgagtagtaacccctaaaccataacggcactgaagtatgccgtttattctaattcccggaggttcaaatcatatggcatataaatcacttgattccattgtgcagtactgcgccgaacacggagcagcttttgatgaagccgtgctcgaggacgatatgcaggagagggacgtcaccagagaggactccttaagcagtatgaagtccatgtggcaggccatgaaggaagcggcctcttcctatgatccgtccctcaaatcggcaagcggcctgtccgggggacagggtgcgctgatgacggcttatatggagcagggggatactctgtgcggaccattcattaattccgtcatcagagcggcacttcagatgggggaatcgaatgcctgtatgaaacggattgtggccgccccgactgcgggagcctgcggagtgcttccggccgtcctgattcccggctgtgccgagtttggttttgaggatgaaaaaatgatacgctccctctatgttgccgccgggatcggacaggtcatagcggagcgtgcgtatattgccggagccctgggcggctgtcaggctgagatagggagcgcatcggccatggctgccggagccctcgtatttttaaagggaggctcaccggatatgattttaaatgcagtggcaattgcccttaaaagcctgctgggccttgtatgcgatccggttgccggactcgtggaagtgccctgtatcaaacggaacgtcctgggagccgtcaatgcgctgaccagcgcagatatggctctggctgggattgtcagttttgtacccgcggatcaggtaatcgacgcgatgaaagaagtgggcgataaaatgcacgcttccttaaaggaaacaagtctgggcggattagccgcttcaaaatctgcacgtaatttgcaattttaataatgacttttcagaatttttgcgttataatagaggcgagaagcagaatagttttacaaattgaaaggagtgagatcgatgatgggtaatttagtaattacaatcggtcgtgaatgtggcagtgcaggacgactgataggacagaaactggcagcagatctcggtgtgaagtgttatgataaggagcttttaactctcgctgcaaagaacagcggtttgtgtgaagaactgtttaaaactcatgatgagaagccgacaagcagttttctctattcgcttgttatggatacatattctctgggatacaatacctccgcatatatggatatgccgattaaccacaagatctttctggcccagttcgatacaatcaagaagctggcggaggaagaatcctgtgtcatcgtaggccgctgcgctgattatgcgctggctgattatcccaataccgtcagcgtctttatctgcggcgacgaggaggataaaatccaccatctgatggaacgccacaatgtggatgaggcaaaagcaaaagatatcatgatcaaaacagacaaacgcagggccagctattacaattattattccagcaaacgctggggaagctgcaagagctatgacatgtgcatcagcagcagcgccgtaggctatgacggagcagttgatataattaaggaattcgccaaaaagaaacaagaatttcttaaaacaaagaattataagtaactgatataataagaccggtatgcctgtttgttttgaacaggcgtattggtcttttataatgtcaataacttaactagaaaagagttaccccaatgagaaagttccatccactgataacgagaatcctggttatgactgcatccgggatcctgcttatttcaattgcaggatcctatacgccggctgtttcaccagcgccggaacaggcaattcgtatttctcatgataatgcggcggatatatcacagtccggctcgctgcctgtccggattatgaatctattaaatcaatttgccggtaattcagcctcctatctctcagggctggattcgaaaacggaggaaacctattctccttccgtttttaagtataatctgatggcgctctatcccgatgagcaggagatatccccggaggatgagacggccacgcagcaggagcgcgttatgcgcctgctgaagtataacctgaaaccattctacgattttttcaagctgtcctttcatacaagggcctctgattcctacggcggacagatgtatgagtatctgaaccgtaaagatgcggaatggacatccgagctttaccggtggctgcaggcgtcgccagagcaggccgctaaaatgctccggcatccggcatcctccgtcaccggtaagtacgatccgaccaacaaagcccacgatccggccaatccggctacgtggctgatcccgtcgtggaaaaacgtctcttttcaattttacgatggagacggcaaaagtatttccctctattccaacgcacaggaaatcgcttccatggccagcgtttacacctggtttaccggatggaccgatgtggataacttcaaaagctatattgatgaattatggcagttatcccacggttacagcgtgacagtcggtgctgtttattattgcgacggctgtgtggatccgaatgatgcggaatcagatgacgatgcagagacggaacccgccttatcagcgccttcagagacctccggtgaaagtcaggcgattccttcagatgtcttgccggaagggcagaatggggcatctgaggcttcacaggaagcggctgcagcccaggcatctccgtcagagctgtccggtccctccgaagataccgccgccgcggcaggagagcatgcagtgggcggccaggacggtgaatccgatgctgttccggcagccgaggaaacgcagatactcaacgaagaaggaaaattttgtcccggccatgtcgatttgaccatcacggcccgtattaccgggctttcagaacagaaaaacctttttaccctggataagagaggccacatgaagacagaggcctggaacggatggtccgattacggcaaagcctatgtcaaccggctgaacagccaggactgggcgcttttatataatctgtccccaattgaactggcactcggaaagccgctgacctttacggagatcagtgagtatctgaaactgcttcccgacgatatatcgagtgagagaaaggcagtcattacatacgccctgcagtctgtcggcaaaattccatactattatggaggtaaggcaaaggcgccgggttacgagggcaataattttgccgttattaccccgcccgacagaaaaggacgtatcatatcaggacttgactgttccggatgggtaaactgggtttactggtcttcccttggaaagatcccgactaatctcggcaccagcgggctgatatatgccggaagggcggtaagccggtccgacttaaaaccaggcgacattatcataagactgggggtaaattcccatgtcgtcatgttcctggcctgggcaccgaacggccagatgatatgcatccacgagacaggcggcagcgtcagcaacgtcacggtcagtgttatggatgcaaactggccttattaccgttctttattagattaagataacacgctttgctttgcatcattttattgtttatgataaaataagagcagagtaaacgttactgttaatcatatttcatcagaaagaaggtatgttccatggagaaagatattttaagcttcgcagttgaaaaaactcatgagttaatcggtgcgccaacctgcagcagcgagacaaaagctgcagccgaggcatggctgaatgcggtgggaacagagcaggaggcagaagaaaccaaaaaatatattgatgaacttgaggcggatatcatgccgattgacaatttgattagctttgcgggttcggaggccggagctgcgctttttggagccgataccgctgccaatattgcagttcatgcaaaggaaatcaaagctgccggagcgaagttctgtgactgcccggcctgtgcggctgttgaggcaattcttgagaaaaaagaagacatacttaaataaagaatcaatacgtatataaacttccgtgaaaagtaacggcaagtaattaaggcaacgcaaaatatattttattgaagtgcggagcaatccggtatcaaaggggtcaaaagaccttttgaccccaacatcatatcattcggtacgaaaaggcatagcctgcgttcttggactgagcgcaggctatgcctttttgccgattcagaagaaggagtaatcagaaatgaatagaaatcctgataaaaagaatggaggaaatccggcttatttcaatccgatacaaaacggtgaatgaagcggcagcaaagcttatgcagatgaccgtcggattgagttgctgagtcgcttcttaagtgttataatattatcctatttcggatgaaatgttccgaatgatttgcccgtatatttaaatattaacagagaaggacacagaccatgataaacagagaagatatgctggagcttacaaggcggatgacccttgcccgcacttccttcacaaggattgcaggatgctatgtggataaggatggtgattttgatgggagttttaatacaaattttctaaaactatcgtcaccggaacggacgaaaaagcttgcactggcaaaggaaatcccgttttcaccgacaaatgtaaacctgaagaaatatgaatttccccaaagtgtccgcaaaccgggcagcatgtggcagctgcttatggcaatgaaagagtgcggtctgaaaaatgacgccctgatggatacattttatgatattgtcatggagaaatacagggcggataaagaatatgccattctggtatttcatgatcgtttcgacattccctcaaaggcttccgataaagaaaggctgtgggaatcggaagaggtatttgaatatatcatttgcgctgtctgcccgctgtccggcgagtatgagccaggaaaaccggaatacggatttttgttccctgcctttaccgacagaagcgcggatctgaaccatattgatatattccagatggatgcaaaaaggccgcacaatgaactgctggaaactttgggagtatgtcccgaaaaatagcggattttgatgaatttcatgtccgggaactgcctgagtttcagcacaacatcggaccgcacaaaatgtcaagagaaaacctccttaatcctttaagatatgtatatacgcagcaacagttcagacaggttttcacacgcggtaacattcttgccggctgaattgtgacgatgcgtaacgcagggagaggggaaaggagaaagatggattggattacaggtatacagaaagccattgactatgttgaggcacacatcacagaaccgattgattatgaagaagctgcaaaacgggcttattcctcaagcattcccatgcgtgggaaagatgccggaatcgttccagaaactgtatcagcagatttacagtgaatttttcccatcaagtgaataccagccctgcggaggaaccgacttcgaggcatacccgtcggcagatgtctattcaccggattatcattgtgaagtctgggtcgcggttgaaaagaaataaaagatagaaaaacaggcgctgtgcttatacatgacgcctgtttttcatctgcggccaggagcttattatataaatataaaaattaattccttcaatttgattgatttttatataaaacagtagtatactgtcctatatccaactattcgtgaaagtctactttatcgaatagttggacaataaaacctaccaaggagcattcttcttatgaaattacagcgattactcagtcttacccgtcaggccgtggatgattacgctctgattgactctggtgacaaaattgccgttggcatctccggcggcaaggacagtctgactttattatatgcattgcatggacttaaacgtttttatcctaatgaatttgaattgtctgcaattactgtagacctcggttttgaaaattttgatttatcaccggttcgatccctgtgcagtgaattatctgtcccatttaccgttgtaccgacggatattggtaaaatcctatttgaaaccaggaaagaatcaaatccctgcgccctctgtgctaaaatgcggaaaggcgccctcaatgaaacggcaaaacaactgggctgcaataaaatagcctatgcacatcaccgtgatgatttgattgaaactatgttattatctttaatttatgaaggccgcttttatgcgttttctcctaaaacctttctggaccggacggaacttacggttatccgtccgatgatttatgtatctgaagctgatgtaattggatttaaaaacagattttcacttcctgtatgcaaaaatccctgtccggtggatggaaaaacgaaacgcgaatatgttaaacaattaacaaaacaactgaatttacaggcgcctggggttaaggaacgccttttccatgccataaccgaaggaaacattgaaggatggccggataaaaaattgccaaataatgcgaggtgaaaataatggctgctctctcctatcatgaacaggaaataattgagaatacaaaaaggctccgccagatgttaaaggaactgccgcccttttgcgctgatttcttcagaggaattgaacccaggacttcttcccggaccagaattgcatacgcttacgatttaaagacattttttgattttctcagacaggaaaacccgctttttgccaactgtgaaatgcgtgacttctctctcactgttctggatgaaatccaggtgatggattttgaagaatacatggaattcctgaaatgccattccacggaaaaaagggaagatttagttaatacagagcggggaatcatgcggaaaatcgcatcattaaaaagcttttataattatttctaccgacacgaacgtattaagaataacccggccgcattagttcagcttccaaaacttcatgaaaaggaaattatacgtcttgaggtcgatgaggtcgccagccttcttgaccaggttgaagcaggtgcgcaactgactgaaaagcagaaggcgtttcatgccaaaactaaaatccgcgatcttgcattaatgacactcctgcttggaaccggaatacgtgtctccgaatgcgtcggcctgaatataaatgatgtggattttaatacgggcggcatcagaatccaccgaaaaggcggcaaggaggtcatcgtctacttcggcgcggaggttgaagatgcgctggccgattatatggcagaacgtaaacacatcactcccgaaccgggacatgaagacgcactatttttatcccttcagaaaaaaaggctcaatgtacgaagtgttgaaaaccttgttaagaaatatgccaaaattgtaacccctttaaagaagattactccccataagctcagaagcacctacggcacgaatctatatcgggaaaccggcgatatttatctggtggcagatgttctcggccacgaagatgtcaacacgaccaaaaagcattatgctgccttagaggacgaaagacggcggagcgcacgtaataaagtgcaattaagagataaatagtaacaataaataacattctctccccttccggcccttcatgtggttttcatccggcataaaagcaaaagtgcatcgggaggcaggggcatggatacaagccgctctgcttcatgctcctccgctcccagatacaatgtttctgaaatcagcggtctctcctcacaaaattaccgccttcgtaaattctcaccggattccccctctccagccggttatgttccagccacgccagttctttttccttccttccgctctccatgttcctctcggctaatatgtcacagagacggttgactgccagttttttattcatatgctggctccgtgcttctgtggataccactgaaatacctgtgggaatgtggataacgcgcacgcctgtttccactttattcacattttgtccgcccttgcctccgctcctgaatgtttcaaagcgcagcttcagctcctgcgtcagcttaggcatattttccagaatgctcacatctatataccagttcttcctcttatgctttggacggtatggacttttgcagacccagagtatgcttccctcaagactgctcatatcttcttccgtctcaaatatgacggaggaaaagcccttcgccttacttcctctgacgcattgtaccatccttatatctcctatttccttttgaagctgcctgtaaaaaagctctgccgcaagttcgcactctgccgggccctggccggaactgatttgtattctcatattccccacctaccctttataagtaatcagcggacgcagtgtggcagccacctcgatcaatccgaattcctgaagggatgcgatgacctgttccacattcttatatgcctccggcgcctccgcaaacagcagattcgtgtcatggcataccacctggcttttgaacttagtactgcgtatggaattcctgtcatatttgcggtcaatccggcttttacagacgctgcgcgcccattttcttccggctccgtgtgaaagggaatccagggaaattccggtatcctttcccggaacacacacataggtcaggctgcctctggaacccgggataaccaccgcgccgtgctttgcggatacgcttccctttcggtgaagccacccgtcttcggtctgttcaaggtaattatgacagctttccatcaaaatatccagctgactgtccgtgttcagataatccagaagctttccggcagccgccagtctgttgcgccccgcccatttaagtgcatcatcatgagctgccagataggccgcagcctgtatagaatcttcctctatcccttccggtctgttatagcgggaaaggatctcctgtccgtaacctctggaaccggaatggaccagaaccaagacgttttcgcctaaaagtcccattgcctttgcggcagactcatcatatacctgttccaggcattgaaattcaatgaaatggtttcccgaaccaatagttccaaaatcgcgtatcgggcactcttcctcataaggattatcacaggggatatctcccagttcccggatagaattaagccgtgtgacccatttttccatcttaaaccgttttcttcttacctgtgtggaaaaaaggctcatgccgcagccaatatcattaccaattaaatgaggataaaatcttccccggctgaaagccgccattcccacaggcgtgtttcccggatgcagatccggcagtcccacggttcttatcattcccggaagtctgctgacgcctcttaactgatcgacagccgcctgttctacccaatttttaccgctgctgattaatatgcaattttcatgattattcaaatcgtatttctccttcataagctgacaggctgtgaatggcatactaaaaaaaggtacaaaaaaacacgacaacaagccgtgtgcaataaaaagtatacaccagtccctgtctgatttgcattgttattttgttctcaccatactcctatcatttgccaacataacaaccaactccttttcttatgaagaacttacgtcttcttattctgaaatttactataagctaaaatccggaaaatgtcaacttaaaagtttgtaagtcgtgatttcaccgtgtatcactgtaacagctgatgctgcctgaactgtgacggaaaactgatattgtccccggtatcctgcttttcattttcaggaaccggaaacaatgtcagtacctttaagtcattgtatcatcgcgcagggcatcggataaattttccctgagaactcttttaccgccgatataatatgccagggccacaaagctcacaatagccaggctgaagacagcaattgcggcggcaggaacctccggccatacctccgccggattcaaataactggctttagcggtaaatacaataaacaaataagtcaaaggcagggtgataagaaccggacgcccggcaataaccagcacttccgcataaaacatctttcttatgccggcaggcgtcatacccacagacatatattgggcaaattcccgccttctctgacgcataaatccaagcgtataggaaaacacattggcaatcccaatcatcgcaagcagagaacagaaggctcccataaccagcttatagctgtctatgatggaatcattcctaatccgggccttaatgcggttctcagattcaatctcataagaacgtccaagcatctgtgtaatctgtttctccagtagattcagttctgtaagggtaacccctttcccggctaatatccggagatttgtatctgcttcggcagttcctgtcttcccctccatattatgccacaatgacacgggaatgaactgtacaagagaataatcggcatactcttctcttaaaaccggcggaacctgcgtatagccgagtacagggatttcttctgtgtccttgttcccggaattttgaagtactatggtctcctggtcttccctcatatatggaacatactgcctgtaacgaaaaacgctgtttatactatcccatatccggttcaatattatcgtcccgtcaagccccggcgtgatactggtatcctcacagtaccttataaatgccgcatcatccataacaataaccggagcccttacctgccatacgccttctgactcagatacggaagcgccggcaaccgcagcagggcctccaagtgccgtaagctccggactgacggcatcctttggcacctgaatgaatgcctctgccttctgatatgcgacggcatcacgtacttctgccatcccctccagtgcctgtgccggcccggattgccggaaatcttcaattttggtatcttttattgttatataaatatcccagacatcctgataacgctgaaaataagtgtatttggtgttgagatcggtaagagaaaaaaaacacagcatcattgtaaaccccataaatgacaagatcagagacaatgtggaagtgcgcagcgctttcctttgcgccttcagcgcatttcccgccagttccccctctgtaccaaataaaattgagagaattggagaatgcctttttctcctcagccctgttacacccgttcccctgattgcttccaacggcgtcatcctgcttaattttccggcaggaagccaggcagagaacagcacggttaaaactgacaacaatactgcaagaattaatactaaaggatggtaatgaaaaccaatgggcaattggcccggcatgccggccgcaatgtactcaatccccctctttactgcaaaactcagcacaattcctataatattacccgacagtatcggcagtgcacaaagcacggccgcttcctgcatcaggcaaatccgtatctgtaccggcgtagccccaatgctggataatataccgaactggtgtactctggcattcattgataccgcaaaagaattatggataatcagaatcagggacagggaaaccaacgacagaatcacaaggtaaagtgtcagcaacagcggaggtgtctcatcctgcgggtcatgaatcaggtatctggacaaaagaagtgcatggcaggataccgccttttcatctaaacccagccgttttgcgatcattggcatgtccttgtaaacagtcctgacattgtggaaataaatatcagccacgataccctgttcaccggataaagcttcgttaactaccgctttttccacattagcaaaattctctattgtgagtaagtcccccgcatccgttactccggtgagcctgccctgccaatccccttcctccaaaacaatcttttccacttcataaacccatacattataaaacatgctgcacagaaaagataaaaacaaactggatataaaagcggccaccatgatggatatactggatgcacggttgtttctgataaaccccacagaataatctttccacattatctgccaccccgtttctgatcacggatgatacgcccatcctctatcgtaacgatacggtccgcttccagcgcaatattttcatcatgcgtaatcaatagtatcgtctgcttcaagttgcggttcgacagctttaacatatccataatttccttagaatttttccggtccagattaccggtaggctcatcggccaaaagcagcgccggacggtagattagtgctctggcaatcgcggtcctctgctgttgtcccccggataactggtttggaagtgcttccagtttatcagagagacctaaggaatttacaacctcatcaaaatattccaggttcggtttctttttatccagtaaaagcggcatcagtatattttttttgacagtgagcgtagggatcaggttatagaactgataaaccagtcccaccttcctgcgcctgaatatggcagattgcgccgggcttaaagaagagatatccctcccctccaccactactcttccctccgtaggtttatccacactgccgagaatatgaagcagcgtagatttcccggaaccggatgcgcctacaatcgcaacaaactctcccttgttgactgcaatattgatttgttccagagcaactacccggttatctccggacccgtataccttatttaaattctcacatcttaatatttccacacatcttctcctatcctgttataatacttaatgcagtttcattataacaggccaaagtgacagctcagtgactgtaaaagcggatttcaaaacatcctccgccatctggaatattgctggcccgaatcgtgccgttttgacgttcaataatttctcttgcaagggaaaggccaatgccaataccattctttttagcattttggccacaataaaaccgttcaaaaagatgggggatatcctctctttgaaaccccttcccctcatcccagatgagtatttccgtgtaaagttcattttgaccataggagcaatggacagttcctccagccggagaatattccatgcaatttttcagcagattcatcaccgcttccattgtccagtctaaatcagccgtgatttccacttcacccgcttcggggatattcagcgatacatccgcttcggaaaatacctcctgcagattgtcggcagccagagtaagaacggtgaagacatccacagcctctttctccaggaaaagggttccggcgtcaaggcgcgacaggagcagcagagactcctccaagtgtatcagtctttttatctgcttttgtatttgtgcaggataattcttatccggatgtgtctccatcatctgggctgaaagtgaaatggccgttacgggagttttgagctgatgggcaatattggacagattttccgcaaaattttgtttttcctccagtgcggactctcttgtctgatgcatcattgtaactgttttatatatctcatcctgcagttttgaaaaactgtcttcccccgcctccaggacgaggtccggactgccggaattgattttttcaagcgcttcggccattgtctgtatacgcagttcttccttcttgcgccaggttataaaaacggcaagaaataaaaaactgcctgctgtaaaacctgccacagcaagcagaagcacatattgatacaggggatttatgaaatcagactgccggtacccataggcagtaagtacattttcatattccggttctgcataccgggatttttggttcttatacgccttcagagccgacagtatggacggttccagtgccggatcctcctctataattgcactgctcacgctgcttatcatctgaaactgcctgcggttataaaatcctgccacgaaaacggcggtaagggaggatgcaatcagaccagccgacagaatgagagcaataaatacccccgcattttttctgccaatcataaggtatcctccatacggtatccgaagctcctgactgttttcaggcataacggctgatgcagcttctcacgcaggcgcttaattgtaacggtaagagtattattattcacaaaactgccattacagtcccatacctgttcgagcagtctttctctggttattgttttccccttattccgcatcagaagcaatagaacctgatattccggctgactcaggctaatctcctcttccccccaaaaaaccatcatcccggattggtcgagcgagattcgatcgcaggtgagatattggcctgatacgtttcctgccctgcgcagcagcgcacatatgcgggaatacagaatttccagctcgaatggctttactacgtaatcgtccgctcccttcctgaatcctgaaacaatatcattggaatcgtcccggacagtcaaaaagataaccggcagttcccgccacctggatcgtatccagctgcacagcatatcgcctcggccatccggcatattccagtctaccagtacaatggcaggcaaatgattcgtaatcgccttcttcgcatctgtaattgttgcaaagaccgaaacgatacaatttttttcatacagatattctttcaccgcctgcgcgatattttcatcatcttctatataataaacttcaaccacgagtatgctctccattcctcaaacaccttgtgcagacaaaccgtaccgccgtcagattacttctcaaaatctttatacattaaacttggctgtattcccgtgttgttctggtatttaccgcttttgtacaattcatactcgccgtcgatatcgtggtaataaatctggcaaatctcaacattgggatagattctgaccggctgtacacagaaaatttccagagtccagtaaccggaaaatcctatgtccccgaatccggccgtaacatggatgaacaggcccagacgcccggtggaggaacgtccctccagcatgggaacataacggctggtgctggtatattcatttgtccgtcccagatataatctgttcggctccagtaaaaggccatcctcaggaataatgatacgcgagacgggattcggctctttcatgtctagaacgtgattatcataaaccaaaagttctccagcgagtgacagattgtaactgttgggattaattctcttctcgtcaaaaggctcaataataatttcctttcccatatgctttttgatctcctggcccgatagtatcataattcactctccctttccattttatcttttatagggaagtatatcataaaatctgattgatttctatcaattctgaagctacccggcttacgtccgtttaataatgtcactgttcacatcatgccaaaaagcggcatgatgtaaacaataacacgctttgcgatgcacagaaacggcaaaaaaacgccgttgattgtggtgaaaagttcacttttcatcgcgtcgcgccgtgtaactcggaattttcgtgcaaatacgcacgaaaacacctcgcagaacacaaccgtgtgaacagtaactaataatcttccggttctgccttataataagtgaccgtcagataattccctgcatgaattgtgtcgtctatcaggcagttcatgctcttcaattcgcgcacataggcttccatgctcttctccgaatgattgttatatctttcggccagcttccagagcgtgtcgccttcttccagacgtatgctggtataatatttgctatagctgaccgccgcttcctcctcggccatggcctgcatcagattgtggccgaaaaaacctgagcttaatattgcaatcagaacaagtaaaactaaaatcccctttttcatccccgtgtcctccttggtaaaacgaatctatgttccaaacatttgttcttttccgtaattttattatagtaaacgaacatgtgtttgtcaatggttttacgcaaaaaaagcgaacaaaggtttgcatttttttcgaacatatgttactattatatcaatagaggaggtacatatatggcacagggtaaaatcactgataaacagagagaaattttagaatatatcaaagaaactattttaaagaagggatatccgccggccgttcgtgaaatctgcgaagcagtcaggcttaagtccacttcttccgtccattctcacctggagcagcttgagaagaacggctatatccggcgggatcccaccaagccgcgtacgattgagattattgacgacacctttaacctagcgcgccgcgaagtcgtcaatgtgccgctgctgggtaccgtggctgccggtgcgccgattcttgcccaggagaacattgaaaattattttccgatccctgtggagatgcttcctaataaagagatttttatgctcaaagtaaagggcgacagcatgatagatgccggaatttataatggagatcgtgtcattgtagcaaaagcggatactgcaagaaatggcgagattgtcgtagcgctggtggatgactctgccacagtcaagacattctataaggaaaagggccgtttccgtctgcagccgcagaacgcatccatggatccgattatccttgatgaggtccagatcctgggcaaggtaataggattgttccggttaatgtaacagcctcacctcattgcgcagcggcagcgtataacagaaagcggagtattaagaggcggcagaaattattctgtctgctttctcttaatactccgctttataacttctcattagtttgtttattacgatttaatttaaattattaaatatatgtattatttattttccgtgacttggcacaaaagtttcagaagaacggcagaaatgcgcttataacggcaaaaatcaatgccggaagcatgttggccaccttaatcttctgatggaacatcagattgactcccacacagaatatcagcattgaaccgactaaagacatattagagacagcctggcctgtcagaagaggttctatgaccccggacagcagggtgatgccgccctggaacagccccagagggattaccgaaaagatgcatcctttgccgatagacgaagccatgacaaagacaataatggcgtcgagaactgcctttgcacagagcatggagatatcaccggtgataccgtcccggatagctcccaccaccgccatggcgccgatacagatggtcagggacgtgctgacaaaaccatccacaaatttggtgtcaccgccgctgcccgacttgatttttatccattccccaaattcttccgtatgtttttcaatattcagaagctctcccaaaagcgcccccaatgacagtgagaaaatcatcatcatcgttccccctgatgcgatgcctttctcccctactgaaaagatttcctgtaatgtgccgctgatgcccagaaatataacgcaaagcccgacggcctggatcagtatattctggaaacgctcaggcagccctctttttatagtcagtccaagaagcccgccgccgattaccccggcgcagtttataacggtccctcatcccggcataatataacctctattctgcatacttgtaaaccgatgagagacatgctctgtgaacggttgctattaaacagcaaccttcagacagcatatattgttacatgaaacgataacctgtacgctccgcgcacaggctaccgccatcaatccgcagcaatcagtttacataattatattatgtaaactgattgctgatttaaatctttttattctgtttcgagccataaattattcaagccataaattataattcatcgatacttgcgatctgtttgccgtctctccagatacgttccagatcatagaacagcctgtcttcacgtgaaaatacatggacaatgatatcattataatccatcaatatccagttggccgtattatatccttcgatttgacggcattcatgcccttccttcagaagctcttcctccacgctgtcaaccatggcctgaacctggctggcgttatttccgtttgctatgataaaatagtctgccaggatcgatacatcacggatatcaatgattctgatatcttctccttttttgtcttccagtgcttttacggcgatttttgccattttgcttgcctgtgtcatactgctgtatttcctccttaagttctcccagagtctcggcagaagcagcctcttccaatcggcatgctctagccgcatcataatattcataagcgattctggtcatttcatctatataagcgccggattcatttaaatattcaagaatccctttcataatctggtaaagtgcctcgtccagatcggtgaatgccagtcttctcatctcagtgagcagaggcgccctgtttcttctcggttctatataatctgcaacatacaaaatcttgtccagaagtcccatggccggtttcccggtagtatggcatgcaatagcctgtaaaatctccggatcggtaatcccgtatttattttcggccatccaggctcccagttttgcatggatgatagccggtgcattcagctcattttctgtcagctcaatccctttattccggcattttttaataatctccgactcgtcataacgcttggcacagtcatgaagcagtccggccagctctgctttgttcaaatcatatccatagcgcatagccagtgaaatgcaggtaaaagaaacacccagcgtatgctcgtaacgcatcggattcagtttctctttcaggtgcccccggattcttataaattcctggttttccgcctcataagccgcctgctttaaaatattttttatactttttttaccggacttcttcggtttcggattcggtgtcccgtttgttgattctgtgttcatcattgcctccctgtcagaagctgtcagcagtaaagtccatgttgttttatataccggtacaccgcgtcgggaatcatccctttcaccggctcgccggatgcaattcgttcgcggattacggctgatgccacatccatctccatacagtggagcctccggattttcgccccgtatttctgttccagatatcgtatctgggtatccagtgaacgcttttgttcttcgctttcccggtctgcagccaggaatgtaacggcctgaagtacatactctggatggtaccatttttcaatatcgtggatagagtcggcgcctacaataaagtaaaattcagtatcctgatattcttccctgagaaggcgcagcgtatccgcggtataggtatatcccgccgttctttttatttcaaaatctgaaaggcagaaatatggaaactcttcgattgccgccgacaccatggcacagcggtcttttgaagaagtgattctgtgatctttcttatggggcggagtctttgaaggcatataccagaccgagtccagtccatactcttcgaaggcctgacgcccgagcatcagatgtcccacgtggattggatcaaaggttcctcccataattccgatttgtttcatggcctgtccggactcctttctttacttaggcagaacgatcttcctttttttctcatcctttgcctgcttgtaaagtacaatcttttttccgattacctggacaacctgtgactgtgtcctctcagccagaactgaagctatctcattgccgtcgtccatacagtttttcaaaatactcagcttgattaattctctcgcttccaacgcctctgccacggccgtggtcagctccggcgttacactggctttgccaatctgaaagatcggatcgattgtcattgccaggccttttaaataggctctctgtttacttgtcatgaatttcttactcccgctttcctcttaaacttccttcattacatcggtcggtactctttaccgttatttataataatcaaattccaggccatacatacggacggtatcgccttcctcaattcctgcctgctcaagctcctgtaaaataccactgtcctttaagaatttctggaagaactggaagcccttctccgaatccaggttggtgtagccgagcatcttgtcgatcttcggaccttccaccacaaatacgccgtcttccggatgctccaccgtatagggaagattttccgcctggaactggtattcaaattctttttcgaatataacaggttttctgtccacggtttttaacagctcattgacatggtataaaagctccttcactcccttgcctgtgacggcggatatcgggaatacctttattccctcaggttcgaattcctccctgagccgttcaatcgggtcgatctcctcaccggcatagatggcatcggtcttattggcggcaatcacctgcggacgcgtcaaaagctccggattgtatgattccagttccgcattgatcgcgcggatatccgccaccggatcacgaccttccgtagatgcggcatccaccacatgaacgagaacctttgtcctctcaatatgctttaaaaaggaatatccaagaccgattccctgggaagccccctcaatcagtccggggatatccgccatgacaaagccctgtccgtcgtttaaatccaccacgccgagatggggattgagggtggtaaaatggtaatttgcaattttcggccttgcattggatacacgtgaaagcaatgtggatttacccacatttggaaatcctaccagccccacgtcggctatcacctttaactccatctgaatccacagctcctgggcaggttgtccgggctgtgcatatttcggcacctgcattgtggcagtggcaaaatgcatattgccaagaccgccttttccgccttttaaaataacttcgcggcggttatcgccggacatgtcggcaattaccttccctgattcaaaatccttaattaccgtcccttccggaactttgatcaccaggtctttgccgttagcgccgtggcagcgtttctttcctccctgttctccgtcttctgcaacatatttacggacatgacgaaaatcagtcagtgtattgagaccgtcatccacctcaaaaataatatctccgcctcttccgccgtcccctccgtccgggccgccggcggctacatacagttccctgcggaagctcacatggccgtctccgccttttccggattttataaatacttttgcactatcggcaaacatatatttctcctttcacctgagccaaaaaagcccggtatgcaatttaaccctgctatcaattactgctgtaactctgcgcgctacgcgcacaggtcaccgccttcaaatcgagtaggaggcggtgattaaccgccgtcctctcacaccaccgtgcgtaccgttcggtacacggcggtttcaacagttgacgtgcacagactgataagctatggctaaatcataaaagccactgcttatcagtctttcttttgtcattgccatatttaccgctaccgtttgcgtggtaaaccaatatcctctccggctgtttcctgcctgccatgccaaatcttccggcactcccattttccgcaggttcttcaccttggttctcggtttcttccattgtttccatatacacattcggattctgtggtatagccacttattgagttcttctattcggttcttcatttccgcaatcccgtaataattcagccagccacacatatacacttttatctttgctaatgcagggcgtatgctctgaactgaccttcgggaactaagttctttcagctttgacttcattttcttccatgactttccatgaacccggacatatatgccctttccgttctttcccaatgtaaagccaaggaatttaaaagttcggattgcaaacacgctgactacacggcttttctcttggttcactttcaatttcagcggcccttccagatatttcgtgctcgtctccagcagtctcttggcagctctctcgcttttcgccagcagcacgatgtcgtccgcgtaacggacaaatacaactccacgcttctgatactcctggtcaaactcattcagatagatgtttgccagcaggggggaaagatttcctccttgcggcgaaccttcttctgtttccatgactactccgttttccatcacgccactctttaagtacctcttaatccactggattaccctttcgtccctcacatttctgcgcaggatattcaggagtatctcatggttcagggtatcaaagtatttcgacaagtccaatgctaccgcatggatatatccccgctctgcatactctttcaccttctgaatggcatctttcgcgcttcttcccgggcgataaccgtaactgttctccgagaacaacggctcgtagaccggtgtaaggcgctgtgttatggcttgttggaaaatgcggtcttttacggttggaatacctagctttcgtattccgccgtctggcttgggaatctccactcgtcttaccgggtcgggggtgtactttccccttctgattctctcgataagttctttctggttttccctcaggtatgcgcctatttcctccacggtaatcccgtcgattcctggcgctcccttgtttgcctttactctcttaaaagctctgttgaggttgcccttctccagtatctcctccaagagttccggctgtgcactgtccctttccttccatatccggcggaaagaacggtgcgctctcacatacccttcacgttccgcgctatctctttgcgagcagctatctttgttttctgtacccaatgttctttcctcctttcccagttgtactaaagactcctgttgattcggtccttcatctctcgactactacgacctcggctgacttctgtacgttcagcactatctttcgataatggttatccctttcaggacattccgcacagacctccccgggtaccacacgtctctttctctccatctatctgccacatttaccatacgtgattccgtgtggttattgggcttcgacttgttcagcagccttaccctcacgcatggcctgatgtgatttctgtccgtcagaccagagatttgcccatgggttagtatgttccccacatccggcttccttcagatttcacctcacgatgaacacccttgccttcggctatatccttcccaccaccgggcggattccggactttcaccggttagagacgtgcgccgccgggcgcactgcaaaaacagccccatacattatggtatggagctgtctgaattattcgttaattgctcttgggtaaacagaaacctgctttttgtctctgccttttctttcaaatctaacaacgccgtcaaccttagcgaataatgtatcgtctccaccacggcctacgttgatgcctggatgaatctttgttccacgctgtctgtacagaatgttgccagctaatacgaactgtccatcggctcttttcgctcctaatctcttagactcggaatcacggccgttctttgtagaaccaacaccttttttatgagcgaataactgaaggttcattttaaacatgacttacacctccttaaatcgaattttgatatattcctctccatatgcctcttcgatattcttaagaccaagaataagagagtccataagaagttttgattctttactgatgtccccggtaaaccggaatgtaaaatgccctgtctcttcttccacattgccgtcaaatccgtcgtccgtaaactgttcgaccgaattcgccatgttgagtacaagcgccgatgcggatgcacatacaatgtcctttccgtaatcatcatagcctgcgtggccttttaattctattttcctggtatttccctcagaatctgaaaatacgtttactcttatcataatttaattaagcattgattttgtcaatcttaacttcggtaaagagctgtctgtgaccatttttcttatggtatccagattttctcttatacttgtaaacgataactttcttgccttttccttctttcactacggttgcggaaactgtagctccgttaacggttgggcatccgatctgcatctctccgttgttaacagcaagaacctggtcaaaaataactgcttctccagcagccgcaccaagcttttcaactttgattacatcgccctcggcaactttgtactgcttaccacctgttgcaataatcgcgtacatatggcacctcctattatcattactcgccagcttcggcggctttacgcacttatagcctcgctgtgcggcacactagaaaataatagcattcttttaagaagttgtcaacatttttttcagcaatatgttaagtaactgaaatgaaaaagtaaattccactccccatttgtctggtggagtttacttctgcacagttgatatttactctttcatacatacatgctatctttatatctccttctgacagcagtagaaggagatgatttttatgagtaaatttattcctggtaaccagaagcatctcacacttgaggatcgtgtttttattgagaactctttaaatcagcggcgttctttcaaggacatcgctaaatatctctgcaaggatccaactaccatttccaaagaagtgaaattgcgtagagcctccgactggtatcacaagggctccttctataatgcaaagaacttttgtgtacgaagatacaactgtcgcaaagtgaacgtctgcaataagatccttgtttgtggcatcaaatgtacttcctgccctacctgcaaccagacctgccccgattttcaaaaggaacattgctcccggctggacaaggctccctatgtctgcaatggttgtgacaagaagatttctcactgcacgattgctcacaagtatacctacaatgcgcactttgctgatcgtaagtaccaccagattctcaaggactccagaagcggcataagcattacaaagcacgaattacatcaaaaagataggatcatctccccattgattgaacagggacagtctccctatcagattgccgtaaaccatccggagctgggcatgtctgtacgcaccatttacacctacatcgataagggactattctcttccagaaacattgatttaaagcgaaaacccaagttcaaaccacgtagatgccacaagacccagattacggatcgttctgtatttacaggcagaacctatctcgattttcaagggttagtacttaattcatttacagaaatggatacagtccactcctcacgagagtccagaaaaacgttgttaacgttctattttaccaaagagaaactatttcttgcctttctgatgaaccgctgtacaaaaggcgctgtacggcttgtctttgaccacctggagaagcgtcttggcacttataagtttctttccctatttgaatatacgttaactgaccgtggctctgaatttggggacccggacgcattagagaccggaatcaacgggttccaacgctgcagcctatactactgcgatcccatgcgcagtggccagaaaggtggtgttgaaaatgttcacactatgctgcgtatggtgcttcctaaaggaaccagttttgaattcctgacacagtgggatgtgaatcggattgtggaccatatcaattccacgccccgtgaaagtctgaatggcaaaacaccatacgaattggctttggaatcctttggcgaagatactttaaaagcacttcagcttaggcgcattgcccccgacgaggtcaatctgacacctaagctgatccgctataaccgttaactaacttacaaaaatctgctgtcggactggaagtaaacttttcacattttttgaatgtggctggtggaatttagtcttgcacacaaaactccagtggcctgttttctctgtcctaaaatatgatttttcgtaagaagttagcctaattatagcagaaacattagaaatatgcttaaaaatatctactatttatactgatttttaaatggtgatggaattcacctttgcactggaatttactttttcaagtcagcaatatgttaagtaggtgtaacagttcagccatgatgtattccgcgaggtgttttcgctgttttttgtgattttgatatcggcctgccggaaacacgtagtggccgcaacaaggccctccccatttaaggttagagacaatcagcgcccggaacggaccatgtccggtgtcgcgaaaaactccgcctacttccccctccatgaccaacctcccacagggacggaagactccgccagtccccctcaccacaccgaacatggtccgttccggacgcgtcctccctacctcagttaaatctccatatatttcagtaacagcgacctgtctgaactgttacagcggctgttttcgcagcagttcatccttcttttgaattctccaatataagagaaaggcggccgccgctcctgctgtttcagccactataaaagatacccagattccggtcagaccgaacggcccgtggaggaaccaggcaaggggcagtgtgatcacaaactggcggagcaggaacacaatcagggaatcaatcccatttcccatggcctgaaacatcgtcggcagaataaacccgatcgatgccggcagaaagctgaccgcaataatacgcagcgccggaatgccgatttccagcatctcgctgcttgcgtgaaacagggacaaaagatatcccgcggccccctcaaacagcaaaaagccaatcaccataatcaggaaacagattccgatactgtatttgaggcactctaagagacgtttcctggaacgcgccccatagttataccccatgatcggcatggccccctgagaaaggccgctggccggcatgaagacaaatgtctgaagcttatagtaaatgccgaacagggagactgccgtattggaaaaccggatcaggatggcattcagtcccatcacgagcagactgccgagagcattcatacaggcattgggaacggctaccgtaagaatctgccggataatcgctccctgaaagtgaaaaccttttaaacgaagctttacatcatgctgaaaagccaccagcacgaaaaatgaaaggcccatggatgtcatctggccgatcacagtcgccacggctgctcccgtcacgcccatggccggtaagccaaaataaccgaaaatcaagataggatccaggattatattcagtatggctccaatagcctgcaacgccatcgggaatatcatcttgccggttgcctgaaaaattttctcgatacagatatgaatgaacggcccaaagcagaagccgacacagatgcgtgcataaatcagcccgtctgccagaatcgctccgtcatccgtaaacatcctgaaaaacggttcgatacagaatgctccggccgttacaaagagtatggaggctgtgagagcaagcagaagtccgtggattaccgcactgtccgcttcctcctgccgctgctcccccaatttcctggcaatataggaattcacgccgactccgatgccgacggaacatgcaactatcagcgtttgcaggggaaaagcgagtgaaaccgccgtcagcgcattttcactgtacctggctacaaacatgctgtccacaatattgtagagtgactgaatcagcatggacagcatcggcgggaacgccatggacagaagcagaggaagcatcgtcctggttcccattttattttccttcatcggttcctttttttcaagttccgttaattctgtcgtttccattgtttacctccagtcgtcggcctcaaaaaaacagccctctccctgctttggtaacataaaagcagtaaagatgggctgtaaatttcagcacttttcaattcacgctttaatcagcgctttaatgattccttctaattcggtacaccgtttggctttactccgcgcccataaacctcatgcagcggttttctgacctttttcctggtaatctcgacgagtcccagctttgtcatatccaccagaactgttttaaccggatccttttttaattcctcctccagtgcggtcagaagctgttgtttatgttcctccctggccatatctatgaaatcaacgatgataatgccggacaggtttcgcagacagagctggcgggccgtctcggcggctgcctccaagttgattttcagtatcgtatcctcggcattctttttgccggaatattttcctgtgttaacgtcgacgacagtcagggcctccgtcggctctatgacaagataacctcccgatttcagccagaccctccgttccagcgcttcctccagtgctgcttccagcttgtaaagcttaataaggggaagaaggggatcctggtaaaattgcagtttttccaggtcagccttctggttcttatccaggtaccgtctcatttcttcatagcagatcttatcgtctgttatcacggactggagactgccggcataggtgtcccgaaggctcaggataaacgaaggctccgctccctcaagaagcgtaaaacaggttctgttttccgccttggccaaaagctcatccatcctctgtttcagggccagcacctccccgccgattacctcttttgtggtctccttcgcgttggttctcacaataaccccaaagccgttgcggcctgtctcttctttcagggccaggagatactcttttacttcttccttccagacagggtccgttatcttagcagaaaatccgatttgcgtctttccaagcgttactaccgagtatttcccggtaaagttcagattgctgctgagtacgggatcctttgtctttacggcatctctgcttacctggacaattatctcatcgccctgtctcagcgtccggccctcctgtgcccctgcggcagccagagggctggtgaatcgatgctccctgttctcagagagactgtagtatcctgtttttcctcctccgagatcgataaaagcggcatttatattttttactatattttttacttttccaatatatatgtttcccagaaggctgccgctctcctccggttccaggctcagggaacggcatctgctgtctgacattagcgccgacaggattcttccgcgccaccttgtaacaatcagtttattcaatgtctgctccatattcttccagtgggacaaatttgtggctgccgcccggggcgccgccgtcactttcatcggacgcatcgttgccctcgtcggcatagacctcttcacgctggatctggaacgcgaaagcaggatattccattccgatggactcatagtaggcgccgacaacctgttccggctttacattggccgtgcttcccgaggaaactttcataaaaatcccggtattatcatccgtgagccggacctcatagatgcaggggcgcaaatccatcgccttttgtcccttttttgtcttttttacaatctcaattttatcgctgtggcaaaatgccagcagatttttcataaaccgggggacatcctccggctcatatccttctctgaaccacatcgtatagtcggcagccgccacctgtgacatcgcatttttcacggaatcgtccagctttctgtagctgagtacacagaatccctccgcattttccctgttgatctgttcaatcatcgttttggaatcctttgtggaattcacttcaatgtccacatactcgccgttgcttaaaataccaactcccagcggtgatgcaaaggacataatctgatgggggctgaacccctcactgtaacggatatccacgtccgctctgcgcatcaccttctggaagtaacgcatgatatcaagatgcccgataaatttgagcgggccctgcttactaaacttcattcttattttcatagcagacccctcctttatattttgccacaccgcagccggaacattttgcacggcagttcggcgtcaccgattcatttaccgcattgttccattcgcgttttaagaattccttcgtcacgccggtatcgataaaatcccaggggaatatctcgtccaggctgcgttctctcaccgtataaaaatcgatatccacaccgcaggtttcgaaggcctgcatccagatttcattatgaaagtgttcagaccatgaatcgtagagcgctccgtttttataagcctcctcgatcactgccgccaccttcctgtcaccgcgggccaaaacgccctccagcaccgtcagatccgcttcatgccagttgtaacgcagactcttgcggttcagcatctctttcatcctggaattgacaatgtgggcccgctccagaaattcttctttggtacacattctggcccactggaacggcgtaaacggcttcggtacaaagaatgaggtgctggcggtaacctgtacttttccggaacgctcttcctttggaatattatagtactcttcggccaccttctcggacagctcggcaatcccccgcatatcctccggcgtctcggtgggaagccccagcatgaaatagagttttacccggttccagccgcctctgaacgcctcggcggaaccgttcaggatgtcctcctcggtcagtcccttgttgatgacgttccgaaggcgctgggaacctgcctccggcgcaaaagtcaggctgctttttttaacatcctgtaccttgctcattacatctaaagaaaatgcatcgattcgaagagagggaagggatacgttgattccttttccgtcaaactcctctatcaggaaggataccagtccctccaactgtgtatgatcgctcgagcttaaagagctgagtgaaatttcctcatgcccggtgctctttaacatcttataagcaagatctttaagctcttcaaggctcctctccctcacagggcggtataccataccggcctggcagaaacggcagccgcggatgcagccgcgcataatttccaggacaacacggtcctgtgttaccttaataaacggcacaacgggtttttccggataataggttgcgtccatatccatcacaagctgttttgacaccttatcaggcgcatgaggattgacgggaaccatccggtctatggttccgtcctctttataccagacatcatagaaggaaggaacatagatgccgggaatctcagccgccatttccagaaagtccttcctgcttccgccatttctcttattctctttgtaacggtccagcaggtcgaaatacacgacttcgccctcaccgagatagaacaaatcaaaaaacggcgcgatcggttccggattgtagctgcatgggccgccgccgattacaatgggatcttccccggttctgtcttctgcgtgaagcggaatatgggacaggtcaagaatctgcagaatattggtatagcacatttcatactggagcgtgatgcccagaaaatcaaaatcctttaccggatcctggctttccacagcgaaaagcggaatgtttttctccctcatcaacttgtctaaatcggtccacggagagtaaacacgctcacaatatacatcatcccgtctgttaaacatatcatagaggatctggatgccgagatgggacatccctatctcataaacgtcagggaagcacatggcaaagcggatatccactttttttgggtccttatttaccatgtttacctcgcccccgatatagcgggcgggctgctggatactaagtaaaatttcatcgtttaaagctagttttctcattatttttccttatttattgtgctgatgcacagtattttaaatcgattgtataggccaatttgtatcgaaaggagcttctatttgcgtctttatcttatcccaactgagtaacacgggataatacaatatgccacaacgcataattataaggcatttcccggtattaagcaatagtattcggcagttgtcggaacactctccaacaacctggaagttataattgtttgaaataggattttaattctgatttacagttgtcgtccagttgcttaatttcaatgccacggatagcactttctaaatgataaaggatgacaacacaagtgtttggatattgctccttgagccgaaaaacagcttgcctgctaccaatttcaattaattcttcggctgaatgaacaccaactgaatgaagtttcttttccattgttttccctaatcctaaagctgtaactgccgccatgtctttctccttttcgttagcttatgttaattgtcaaacttccaattcatgctctaaacaactttacgcacaaccggagtaggactcggggcggagtgaaagttaatcagatagccgtctgcaattttttaatttcctccatattgtgttctgaatatttttcaaagacaccgtagacaatcatcccggcctgctttgcacttctgaccgcagtcttgtgtaatttgcttagtcccatacaatttctaaacaattaaaattctccggaatgaatggcatgcataaataaatgtccaattctgtcggacttatttcaattacaccgtcagaacataaccatttacaattgactgttttttctaatttagacggctgcatgttcgtacctgttacgattgagtctcccgcaagagttaatacctccttctctccgccctcttcaatttgagtatcatcatgcaaagcaacacgaacccatactatatttgacattaactcaatttcccgtaacctatcccatatttcagcaagcgtagggcgaccttcttccttttccaccgcttcatgagaccatgccgaaatataaaaatgcagcccttcagccatgacttgccatgcctctgtagttctttcatggcaatcacctttcttaattatatgcgtctggcatataaatcaaatttaacatcccattcaccgtcctctgttaccgtaacatcctgccagtgaaaccgctcgtcctcaattttggcaaagacccattttctccgttcgtcctctatgtttgtaagaacgatgatgtcgtcctgttttctcgcttcaaaccgcatgattcttcctgtatagcaataagccacatcccaggcgtgtgtgtccgggttgtagacacgaagggtcgttccgtattcaaagccgggcaaaatgatcacatcctgtaccgccattccctcaagtacccatgaaaaatgccattcgcctttgattacatgggaagtgctgttgtcaacatagtcaatgttccagctgccgatcagcttcccgaaaaaatcaaattcctcgggtaagacctcattttttttcccgcttgtgagtgccttataaaaacgctccatatgtaaatcctcctgcctctgtaaactctattccggactaaccggtacttctccattaactgccgcaaactataatcgcccaattcgcctgatttgcccgttacaggtaattctcaattctgcactgctcatgcagggtatcgcccaacagtgtaattgcctgatggggacaatgacagatgcagcgataacacatggtgcagcggttatggtgtactgccatttgattttcaactgacaaattacccattggacacagctttatacatacgccgcagcctacgcatttttcagaactgattttcagtttatcggaataatgctttgttttgtgagaaaaccacagtctctgcccaaataatcccgccatgtgggatagaaatgaaagcccctcccgcggggcctggccgcttttgaatgcctgtgccgctttttttatcttttcttcagcctgcttcacaaggatgtgattctcttctttcgtttttttcagcagtttttcatcgccaatgcaatcaggcattttaagatgtaagccgccaacgattaaagcgccatattttttcaacagtcttgctgcgcagcccgtaccatcgccgctgaataaccccatggtcgaaagaataaagacttttttccctgaaaagacaatccggttgttttccaaaaaatccctcattattttaggaagattgctaaaatatacggggtatgccagaacgatgaaatccgattgtaccatagcttgtaccgccgatggatgttcgatactgatacagtccgcatctgtatccaagccatgaacaaatttctcgatacaatatccggtatttcctgtgccgctaaaataaactcctaccatctcaaaatgctcctcctaccgcttcacatttcgctaacttctttatatcttcctttacaaataagcgcactccagtacgtcaaaggagaacattcgtattaaatcatcacggtataagcccgtatgcttcaagtgtatccggactgttgaacatttttttcaaatcctgtaatatccatttgccctccagttcgattcgtcgaacagcttcccggctgctgttcaagtcaagggttttacataaatctctttttccgtgtcaagcacaaaaccgcaggacagcagcaggccgcaggaagccatattttccggctccggctgcaccacaatccttttggcgtcagggtgaagggcaatcctgtctgtcaattgcgccacaatcattttgccaaagtctttgccaagacagtcggcttccccaatcatgtagtcaatgctgtaagacccgcccagcgccgtgtagccctcccagagctcttcgctgtccttgcaggcgtaatattgacaaaaaccaatgggctttcctgcatgctccacaatgaagtggtgaatccagcaaaacgcgccgtcctgcttctccacctcatcgatccaatccagcgggtcgtggtaccacctggcgatgtgcggcgtatacagccatttcctaaaaaccggcaaatccgtctgttccatttttctaagttgaatcatttcgttttccagcctttcttctttttcagagccacggtgcaatcatggttcccgcgtatattacgaatgcgccttcatccggatcaaaatatatccatgtgccaagcaaagacaggacggcggccattataggctgaccccacattactttgatgtgttctcctgcaaaaaagcctaaaattaaactgaaattacacgatcgcatatcctgctgttgccagcacacggatggcccgttcaaagtcctcagccttgacaagtatgtaatccgtattgaatgtagaaacagcaaagataccgatctgattctccgcgaggataccagacaactttgacagaatgccgacgagggaaaaatccagcacaccctggatgcgaatcccccgccatccatcctcacgatccgcagtgcttaaaggagtgtcctctgtcctgcaaacaagtgacagttcctcgtccgttttgccgataaagtaaaattcggcggccaggtcgatatcctttgtgtctgccaccttgcatactgtcagatgatagggtagtttttttaattccatattaatatcctccatagtgatttgtcaattgaaaagatatttcaacaatatctcccagcttctttcttttcgccgtttgtctcgccaccacattcaataatttcacgcaataacaactgatcatcctataaaccggtaagcgcagactattcataccagattaccgccaggtgtacccctcaagccatccggctgaacattgacgccgaaatcacctgccaaagtcattaaaacagccttttcccgtctgaaatatcgataccaagttcttttgccataccggtctgcttatatggattgattttttccacaatgccgtcatgccggaaaagagagcctgtgttcttaaaccagaacgtcgcccccgcactcacgcattgctcccggatgttcagcacccactcataatcgcactcacgcgctgcccgccctgttttgccgccaacggtaacgtgatccacaccatgaagatagggggtgaggtcgattgcttccagaagcggagcgcaggcaatgaaacggcgcttcatcggataagataaaaacagggggagccgggtatcagccagcgcctggttttccaccgtgcagcctatgttcacattgtcgtaaccctcgccccagtcagagggaagggataccggaaatcggtcaatccgcttgcttagaatcaaaaaatcaatgtccgtccgttcccggatcatggcccagacttctccccgccattcatccgcttcgggcaggaaaaagtcggtggcaaagcaggtggcgaggatcttatcccccttgatattgtattcgccctttttatttctcctgacaggccagtcgaatttatccgttttcaagattgtattctggccgtatcgttttgcatacggcccgtaaaagtaacagtttgcgcagccgtcacttatttggtaacagccagtccacggctcccagttcataggcagcctcctttcatgttttttctactttttcaacttttttagtgtttcataaatgttccatactgattgggggccgcgcttgtatccggcgatgtattgtcgctgatcgtccattccccggtttccgtgtcctgggtcagataaaaatactgctgcgtgtggccgtcgtccataaaggtctttgtgtggtcgtactccacataatagctcgcccatacgacaacaaagtgttccgcaaggtactcgtccgtccagccacgcgcctgggcaagctcgctaccggtatacatggcaatgacacgtgctgtttcatcttcatccacctttatatcatcgatacgcacactgatcgtatattccttcccggcctggccttcaatcgcgctttggacggtttgcaccgggtcgcgagacggcttttgcagccacggatcgaaccagcctaactggtaagcggcaaatccgcaaaggagcagcagcgcggcaatcaccgcgacgagggtctgcatccgtttcatgcttctggagcttttcgttatatttataaaacttctctcctttgcttcaacaatgtatttatcatcaatcgtttctagtgcatcaagaatgtgacttgcgttcataccactccctccttttttaaatatgaaagcagcttagcccttgtcctgtggagcatggattttactttactggtactaaaacaaaaatctgtactgatctgctcgattgaatccagataccaataacggcagaggaaaacctgcctttccgcagccggcagattggcaataaagcgattgagtgtttttgacagctctgccgccataatttcatcctccaccatgacgtttgaaggaacacattccgaaagctcgtcaagggcaagggacacttcgccgccgccacgcttgtcccggtggatatcccgccatttcttcagagatacgcgccgggtgattttgccgaggaaagctcgcaggatagacggacggtggggaggcatggcgttccacgcgccgaggtatgtatcatttacgctctcgtccgcatcctcttgattgcaaagaatgttatacgcaatgacatagcagtacttcccatactttgacgcagtttccgttattgcgctctcattccttgcccaatataaatcaacaattcggttatcctccatcccttcacctcctatggtttatgtaaaggcccttcacctatctacttcccgttttttggctttggttgcattatttccgggaaacctgacatttaccaaaaaaacagcagaaaccatgccgggcttctgctgcttactgttatttcattgtcagccataaagcaggccggacgccgcctctgttatcaccggtcgcaggatggaaacaggaagaaatattgcaaaggaaaatattgttaccctggatacctatgttgccatcgccatgaatatatacggcttttaaattattgcgcccgggtgagcgaagccaccaccaccatctatggcctttaaatgctgctgtccgattaccattgttttcatcttttatctccaataaatcaaacctcatgtcagactttgggactgccctgcctgctgcctatttggcgcaactgtcttacgcaacgataacctgcacgctccgcttacaggtcaccgtcatcaataaaagcatggctcaaaatatagaactcttcctgactcggttgatgtttcttttccattttctctaatgtatcgtcatacttccgggcttcttcctcggaaattgccataacagggctgtcataatagaaccattttctgccgtctaaccgattgggtgccaattccttcaccatcatggcagccggatatctcccatcttccatgcagatattcaatttcttacagcttttaaagccatggcccacatagttcatcgggcttcccaggataacaattacatcatatccaagcagcacggcctgttcaaaggaatgctcgataagcatctttccataacccattctctgatattcaggcgtaatgctgaccggaccaaaggttaagatttctttttctgttccggcttcatcaaccagccgggcttttgtatacattatattaccaatcacctgatcgtccagttcgattacaaaatccagttctggtatgaaatcctcatgtccgcgcatggtgtgaaccagataatgctctacacaccccggaacatagagattataaaaggccttcctcgtaatttcttctacagccttgtaatcgctttctttttcatttctaatctttatcatttcaacctctcattttaaagcaggtagttattttcccgatttgcaacttgcaatgtaactaatttatatgttgcatatccgccaataaccaaaggctccattttacaaagttcttctgcttcttcacggctatctgttttcagaatatacatacctgccattcctggatagcctttaaacacaccacagatttccagttttccttcatcgtccagctttcttatattttcaacatgttctgtaactgccttctttgttaatttattataggtcttgcttttctcaatcagcatcacatacatcagcttttccattctgcgcattaaccgttttcagtctataggcgttctcctttattactatttctatgggtcagattcccatcgcctgcattctccgtgtcacctcacgggtccgctcctccagatttattccggtatactttgacaatctgcattcagctacgatctctccgtcgcaaaggaactgttctggcggcaatgaaaggatcatgtgttaccagcaaaattgcagtgccttcctgattgatccgggtaaatagctccatgatcttcctttgccgcctttgtgttcaaagctccggtcggttcatccgtgaagataatcccaggtccgcccatcagagcgcgacatatgcctgcccgctgaagctggctgccagaagcctgggtaatccccctgtccttcagttcctcaattcccatttgattcatcagcataacggctttttttgttaaccttttaacgtatcttcggtggtcacgcatctgaggcaggatgatattatctaatatgctcaaattttttaacagcgtgggcttctggaagcccccccatccttcttctcatcgatatccccagcccgaccttgttcataatcataataatatcagtataccaaaggttggaaagaatatctatcttatatttcatttttccggcctgtatcggttttcattgttcttccgtaagccgctgctcaaataaggtggtactcgccgcaaaaaaatgttatattatagctggcataccaatttagttatatgacaggaggagcagaaattggaaaatgaaatggaattgcagcagattatttataaaactctggctgtgcagatagagtttggagtgtaccgctttgaagagcagctaccaaccatagaggaagccagccagctatttttagtttctaccgatactgtccgttcggcctacctgcgtctgaaacaggatggctatatcaccctttccagaagcgtgggcgcattggtaaaggtctgctatgacacagaggataccgaccgccatatacagaacttctatgccatcagaaaagatgctctgattgaattgagccgctccatacgtccgctgttaagctatgctcagtgggttggtttcaaaaaggcttcaccggaaaccctggatcagatggaggctctggctctccgtacggatattctcccgccctacagaatgatccgccacctgcagcttatttacggttctcttcaaaatgagcttctcatgcgcatggtttggcagatctttatgttctttcaggccccactcttcagcatcaggtttactgcaagacggtatgagggtgataattccctgttgtatatgatccggctgtgccgtcagaaagactgggccgcactccgttcatccatagaaacctttcaggagcagctttcccgtgcactgtgcagtttctatgacagcaaaatcacagtgcaggctccggaacagcagatcccctttcaatggacaagctacaaaaaagcaacccagcgctgctactcactcggcatggagcttttgaaggccatcaaccgggaaatttatccggccggaacctttcttccttcccttgaaagactggcaaaggaacggcaggtttccgtcagcacaatcagaaggactctgacactccttaacagtatcggcgttacgaaatccttcaacggtctgggaacacagattctcccacaagaagaaatagcggaaaactgtgactttaccaaccctgttttgcaaaggcgtcttctggactatgcacaaagcatgcagattattgccctgtcctgccgtgaagtatcgagaatcactgctgccgcttttacccccgccgaccgggcccgtgttatggaacggctgaaattactgcagcggcttggacggcaggaactggcttcctacggcattcttgaactcttcacgcacatggctccttaccaggcaatccgaaatatatacactgaactgtaccaacagcttttatggggatatccgctgcgcagcatcattacggatcaggcgcgccgtactgcctgtattacgtatcttgatacgtttatgaagtgtctggagcaatccgatgttgaaggtttatcggcccatctagaggaatttattttttcagaattaagatttgcgtcagcggagctggaaaagctcggcatcggaaatgttacgccgctggcgctgcgtgattttaatttatctttctgatgtcaggcctgaaggctgacacgcaataaggaagtgttgaagaacattcagattgggcagacaaggcgtacaatcccttactgtgcctatccgctgtcaaagatattgtggggcttttccgccttgattacccatcagtaaaggcaggtgaggctgtcaacggcggtgctgtaagcgccgttcatcttgaccgttgactgactcgtctgcctttgctatctccccaacaaactggaattgtcactttaactgatggagcgatacatcaaatattgtttgccctaatttggattctacaccatcaggttttgaggtgtctattcttatagccttttcatcacgtcctataatcacgcgccgcaatttaccatatactggtaagtctgcttctgtaacgtcttttttaagaaaaatcggcattttgtcttgaaagatatgttcttttccatatacatcttccagtttacactcaacccaaaagggctgggataagtcaataatttttgtaacaaccacttctacgcagaccattttcattttcttatcccatgttccctttccatacaacttcaaattcgctgctatgaagctgccttacgcacattaacctctgcgcaaatcagtttcgctatatgctccgctgtttcatttgtaagcaggaaaaacattccatcattccggcattttttatgcgcgttgccattcaaggtataaacaaaacctttcacacaggtatcgctgcaagcatttggatcaataagtctcttgcagtcacgggaagtagtcattttcttctgcatatcggcaggcagggaagcgatgatatcttcatatctgcccgcattgtcgccataaatccgtgccagaatgcccgacttgcgaaatacccagttcattacggttttcttctctagccgatatgaagcggtataaccgcttttcgcttctttgatgacgagttcacagccctgttccataagtttgttatcaagtttcttgacaaacgcttggtattctggtgcaactgccgaaagaaactccttgaatgaacctttttcttttgccattatctttatctccctcaaattcatatttatcattctgctttcttccattctaccacaattccgagagcgtggaaacagagtgttttccgaacagcatttatttcagaacagccagcggcgttattctgcctgtatatgtgagtgtcagcctatgcatggcgcgtgtacaggcaatatacaaaagacttctgtcatagcgggaagaatatgttctgtcatccgcctgggggattagaacttcatcaaattccagaccttttgacatttgaaccgaagttatggtgactccgtttcgaaaaaccgagctctccggcgtgagcagatttgcttcacacgatccgcccagctcattatataatgctcctgccaatatgtttgtttttaaaatgattccaagtgaagcgctgcctcccttccggaatttttggattgcctctttgatcactctgatttcttccgctgtgtcccggcacgcgattagttccggctgttccccatggcgttcaaccggctctaaagccgccacttcctgaatgcgcttcgcgaaggagataatctcataggtcgaacggtagcttttgttaagctccacaaactccgcttctttatatagctcctgaagatccgccagactgtgcaaatggttgggattgataaattgtccgaaatccccgagtatcgttttctggcaggggaacatgcgatttagggccgcatactgaaccggcgtgtaatcctgcatctcatccaccaccagatgtttcgtaagactgctttccttcactccctcgatcacggaatgaagatagagaaagggataaacgtcggcccattcgagggtctttttaaacggcatgacaagcattgaccggttcccagttcttttataaaagtccttatatacggcaagcgtatttttcattgtaagcatggaacccaggctttttgctaccgtcctggtccgcagcgcggcgccttcagcctccataactgcctccgtttcgtagcggtcacggatatcttcagcaaccatcaaaagccgctttctgacaggatatttgctatacgcgcgaaaacgtttcattatccattctccttcagcggtaaagctgccgaaaacgaaatcggcgggtttgaaaatcaagtccggcaattgttctatgtaccgatccatcatggaaacaaatgccatcgttgatttaaactgcactctctgcgcccacgcttcatcctgccgctcaagcggatctttatcaggttcaaattcaatcaaaccttcaagctgaatcttcgcaagctccgacagattaagttcgaaaatcggctcctccccaagctccggtattacatttgagatgtaatcgccgaagacacggttaggagacaggattgtcacattccgagcgttcagcctgtccttaaaccggtaaagcaggaacgctatccggtgcagggcgatggatgtttttccggaaccggctgctccctgaataatcatggtaccatctttttcgtttcttataatctggttctgctccttttgtattgttgaaatgattgatttcatcttttcatcggatgtctggcttaattctttttgaagcacctcatcctgtacatgagaggaagtctccagcgcatattccatgtgaccgttttttattttgaactgccgcttgcgtgttatctccccgaaaacagggccgtccggagcctggaatccggcttttcccacattgaaatcataaaacatgccggatataggggcacgccagtcgaatataagcggttgattttcataattgaacgcaaaccgcccgatataatatctgtcttctgtcttccgggactcttccctgaaatcaatgcgggcaaaataaggggattcttttatctttgcaatccggtcgcggcgctccaccgcaaaggcaccgcttcggtccgtctgcttcagaagcatctcattttgaaacatctcatgaggatcaatatccccccggtgttccaccatataccgtttcgtgtccatatattcccgttctgatttcctgacggattcctccgccttctccagggcctccttaagcttcatgttaatttcttccagatgcagaagctcgtcgggaaacgggactgtcataccgtcactcatgaagcctttcctcctgtcccatcacaaaccgttgggtcgggtagccgtattcgaccagtaattccgcttcagcaaatccaagctccttaatctcgtcacggtacccggtatctgctttgtcaccttcccggtaagtagtaatactgacttttctgcctctcagaagctcacccattaccttgtcgagaagtgctttggggacccctctctttctgtaaagcgggtgactccccataaaatcaatgctgccgttttcataggagaacagcaggataccggcggcaagccctctgtcctttagaatcagcgcctgttttgtccttattttctgcttcaaaacccggatatattcctcctcgtccaggtacgggaatccgtctatcacaagcctcaccagctccatccagcacggaatttctgcctcggtggcaaatgtaattttccacccggcactttctgttctgtccagcatctcataactcctttcaaaatcaaacctaagctgcagcggataaaaccgttcgttttcccggtacatattcggcggcattttatacatggccgtgaatgcactcgtaaatgcctgctggctcctgtagcccgacagaagcgcaatatccacgattggcttttcagaaaagaccagcagctttgcagattctgtcagctgcctgcgtttcatgtactcatgaaccgtcaggccgaccgtatcggaaaacacccggtgcaggtggtatttggaataatggactgcgtccgcaatccggtccagattaagcctttcagtcagatttgtttcaataaagtctatcgccagagacacctcctctatgcggtccatcattcaacacctccttttgccagattagtatatatgattatgggatgcgtgtcttaagaaatcttgctcttcttccatgaaacgataacctgcacgctccgcacacaggcccccgccttcaatgaaaaactgcccctcattaatctataatgcggagcagccgtgtgatttctattcttatatattatttttcaatcttctcaaacttccttacgatggtcagcaaaagctccaccaccttctccatagactgaaccggaataaactcgaatttgccatggaaattgtaacctcctgtgcagaggttgggacacggaaggcccatataggacagtctggctccgtcggtgcctccgcggattggtgatacttcgggagtgatccccacttcctccatcgcctctttcgcgatatcaatcaggtacttatagggttcaatcttttccttcatattgtaataggagtcttttatcttcagctcaacggttccctcaccgtatttcttattcaggaactctgcggcagaagcaaacagctccttcttctgcgtaaatttatccatatcatggtcacggatcagataatccatcttggcatactccacgtctccggcaaactgatccagatggaaaaatccctcataaccgtccgtatacatcggattctcaaaagcgggaagaagactttggaattccattccaatcaaaagtgcgcttttcatcttgttctttgccccgcccggatgtattccaacgccatgaatgtagacttttccggatgccgcattgaaattctcatattccagctctcccagaggaccgccgtccaccgtataagccacatccgctccgaacccttccacatcaaagaaatcagctcctctgccaacctcctcatcaggggtaaagccaattcgaattgtaccgtggggaatctccggatgcgccagaagccaggccgccatcgtcataatctcggcaactcctgccttatcatcgcctcccagcagagtcgtaccgtccgtcacaattaaatcccggccctcacagtcggccatgaacggaaaatcctttaccgtcatcacaatgttcttctcttcattcagaacaatatctcctccggcatatttctccacgattctggctttcacatcccggccggacatggcgggtgccgtatccatatgggctacaaagcccagggaggggacattcttttcagtgttggcttcgattgtggcatagacatagccatgctcactcaggcgtacatccgatgcacccatctcctccagttccttaaccagttcctttgccagaacaagctgtttttccgtgctggggacctgttcctcctcgtcttttgactgcgtgtcaaaagagacatatttcagaaaacgttctgctactttgctcatatcttcacctcgttattatttaaaaaaattccacacatacatactttaccataaattttgattttctgcgagtcccggcataatattttagttaagcaggtgaggacgtcgccgcaggccagcggacggggtggtgaggtgtgtatatgagtctttcgtcccgggggaaaccctgacagggggaagtaggcggaatcaattgcggaggggacatgggagtccgccggtgcttagcgaggtccctcacgagcttagcaccgatgcgcactccaaagagtgcaaacggtccccgcagcaattcattccggccggattccccctccacaaccaacttcccacggagacggaagactcagtcagcccccctcaacacacaggacatggtccgttccggatgcgtcctccaaacctcagttaaatctccattttaatcgtccctcagctccaggtctctctgaagcggctccagatagtggacataaatgtcgcggaagcttctgattttccacgatttatccagttcctcatatgtaaagcttttccttccgcctttctgcatcctggaccagaacgcgtcaagttcgctgaagggaatataatacatctcatcttttgacgtaaaataaaggatgataaaggccacgccgccctgcgcctcaaattctctcataaactccacctgatgggcatggacgttctggagcggaaatgtggaaaccgcacattccttggcgtcaaaacagacgggtacgccctgaacggcgccaatgtaatccacggtgcttttctggtcaaaataagccatcgtaatatggcggctctctttttcaatactcaccggcgtgattggcgtcggtatcttttgaatcagagccagccctttttcacggtagccgtcgtttgtatgattgattagatcctccagcgtggaaccgcggaggcctctggtattccaggttcccattcttcactctgctcctgctgtttattgttgcttctgttatattaagagatgaagcgctcatatccgggcatccctgcggtcatccgcataaattcttccggtggctttgccgtaaattcccggcctccgagacccgccagcggctccctcagctcttttggcatcacaagccgccatgcatgcagcatctgggattggactgcgtacttatccctcgcttcacggttgacagccggatcgccatacttgtaatcaccggctatcggatggccgatagaggccagatgcgcccttatctggtgggaacgtccggtaatcagttttacttccaaaagcgtatggcggccgtcgctgcagagtggccggtactgtgtgcggatgggaagcgcgtctttatcctccctgcaaagttcattcgctttcaataccgttacctgattcgtcttctcattttttttcagatacccgtcaatttcctttggcccggcaacgcttccctttacgatacagagataatatttccctatcgtcctctctttgatcgcttccgacatcagctgaaggccaggcagtgatttcccggctatgactataccgcttgtattgcggtcgaggcggttgcagacagagggcttaaactgcctcatatcctcctttgtaagcttcccgccgtccagtaggtattgaatcagatactccaccagggattcatccgtctcctttgctttctgtgaaagcatcccggagggtttattaatcagaatgatatcgtcatcttcgtaaaccacatccagctttctttttcttaccttctgaattttcacttcggaaaatttctctattgtctcatccgagaggaacagtttcacctcatccccctccgaaagcttctccgaaccgtcgcatttttttccgttgagtgtgatatttttcttcctcagcatcttataaataaaacttttccccgccagatttaaatactttgccagcagcttgtccagcctctggccggcttcgtttttcgttatttttacaacctgcatcgctcctgcttcctcactgccttgtcattttcctacatacacagacttttcatcgtgtttaccgcatattccacactgccgtcatcctcatattccgataccggtttcaggcttttaagccttttatcaaaggtgctcagttctccggtaatcttcatgttcggatccagtctctgggaaaccagtatctcatttaaggatttttcagcctcatggatatttactttcggattaatgcagtatgcgtagataccggtcggatggacggcaaccgcatccatcggaagtacataatccttcgtcgtcagcaccatgtcaaaaagcatggggaatttctcttcgtaaacagaatatttctcataaaactcttttgacggagttttgtatttgatgatggcgaccagaggagaagccagatttgccgccggaagtaccgtaacaatcgccataacggtcaggatgttctttaccgcctggctgtccgtaaagtagcgcgccgccagctgtgcaatgataaacaccgccagaactgaaattaaaaaaatgtgttttttcttaaagctggtacggtagccgtactcacctttccttatcttcttcaatttgtcttcctttcctcccgtaacagttccgacttttacggagttttatcgataactgcattaaccgggctttccacctgcttccctgaaatgcgggacatgattttcagtatcacgccgtgcggcactgttttacatagcagtcggaatgatttcataagaaatccatacacagatacaggttttcccatcaggctgtcccggatggcaagcttgaccactttcaccggatccgccattgtaagacgcttataaagcggaatacgccccgtagtttcagcgatgtcaaaaaactcggtcttaaccggaccggggcagacggccgtaacgcagattccccggcctttcaattcttcccccagcgccaggctgtagcttaaaacaaaggattttgtcgccgcatagatggcaaagcccggctgcggaaggaaagaggccgaagatgcatactgtataatcctgctgtttttgctcatatagggaagcaccatgtgggtgacggcacatagcgcctcacagtttaagcgcaccatccccgtctcctcctccgtcgaaacgctgccgacccgccccatctttccatatcccgaggcattcaccagtatcttcacatcaggctgttcattttgaagggccgtctcaagctctgcgagctgttctctgtccgtgagatcaatcgcaaattttctgaccggcacgggtagaatctcttcgagctgtgaaagcctctcctcccttctggccaccagccagatttcaccaaaaccggcaaagcggtccgccagctgtactgccgtctcccggcccatgccggaagatgcgcctgtcactattgcaattttcattccatatcaccttcctgcttttttatgcacattcctgatggtttttttcctggccggcttatcggctgattttccggcaggccctctgccgattctgccgtcagcttttctctccggtttcccatcggcccttttcttattgtaattctggtagccgtactgcccggtctgtctcggccggatcaggcattttttatcaaaaccaataagatcggttctgcccgccgctttcagggcctcggcaaccagctcataatttttcggatttctgtactgtattaatgctctctgcatcgccttctcgtgcggatttgtcggtacataaaccttttccatggtccgcggatcataaccggtataatacatacaggtcgaaagcgtggacggcgtgggatagaaatcctgcacctgctccggcatatagccgagatccctcaggtattcggccagctccacggcttctgtcagggtagagccggggtgggaggacatcagatacggaacgaggtactgtttcttccccagcttctcattcatcttctcatattccttcataaaccggcggtaaacgctgttttccggttttcccatcctcttcagtacattatcggaaatatgctccggagccactttaagctggccgctgacatggtactcgcaaagctcctttaaaaaagcatggccgggatctgcgagcagatagtcgaaacggataccggaacgtataaagaccttctttactttgggaatctcccgcagctttttaagcagggaaatataatcgctgtgatcggcatttaagtttctgcacggtttcgggaaaagacactgcttttccggacacacccccgccttcatctgcttttcacaggaagggtggcggaagttagccgtgggaccgcccacatcgtgaatatatcctttgaaatcaggctctttcgttaacagctcggcctcattaacgatcgactcatggctccgcgtctggacaatcctgccctgatggaaggtaagggcgcaaaaactgcagccgccgaagcagccgcggttactgatcaggctgaacttaacctccgttatggccggaatgccgcctgccgcctcataggacgggtgatagttccgcatataaggaagggcgtaaacatcatccatctcttcttcactcagtggcctggccgccggattctgcaccacataaagatgctctccgtacggctcaaccagccttctgcccgagaaggcgtccgtattacagtattgggtataaaagctctttgcatattccttcttgtccgccgtcagctccttataggatggcagcatcacttcatcgtaaaccgatgccagggactccgccctgtaaaccgtgccgtcaataaacgtgatatccctgatatcgatgccgctgttcagcgcatcggctatctccacaatggagcgctcccccatgccgtaggatagcagatccgcctgcgaatccagcagaatggaacgtttcatttttcccgaccagtaatcgtaatgggccagacgcctgagactggcctcaataccaccgataataatcggttttttcgaaatagagcggatcaggttgcagtagacaaccgtggcataatccggccttttccccatctctccgcccggcgtgtacgaatcctttgcccgtctcttttttgaaaccgaataatgattcaccatggaatccatgttcccggccgacaccaggtaccccagcctcggctctcccagaatccggacactgtccgcgttcttccagtccggctgggcaatgatgcccaccttatagccatgggattccaggatccggctgataatggcatgcccaaaggacggatgatccacgtaggcgtcccccgtaacatatacaaaatcgcattgctcccagttccgtttttccatatcttccctggaaatcggtaaataatcatgtatcattccatattctccaattatctgaccgacggtctgtcatgccggttcatcttctctctcatgagcagttcgtcgtaatcttttatgtaatagtccgccattgactgtttctcttctttcagatcgagtgaaaattcatcctcaaccgcacagacggtcattccggcccgttttccagccagtatacccgccggtatatcctcgaacacgagacactgctgcggtgccacctgaagcgtatccgaaaccttcagataaatatcgggagacggctttcccgatgccacctcacaggccgttgtcacaacatcaaaatacggttccacccggagggagcccagcacggcgtccaccatatcacggccgttgctggtggcaatcccaagcttgaagccacggcctttcagctcgtttaaaaaggctttagcccctgttttcagcggcacctcatgacggtatttatcaatcgacatccggatccagatatcttttatttcattcagctccatcgggagtgaaaagcgttccttaaaataagcggctgtctcggaaaagctcatcccttcgattgccctctgtaagtcatccgggcagccatagccgtaccgcccaagaaattcgatgtcgatagccttccacatccacatggaatccaccagcgtcccgtctaaatcaaatattgccgctttctttccttctaacatatattgcagactcctttatccgtaaatttcgtaaccgttcagacagcatgaacggttatatgagttccctttgtgggaataaattttcatacacgccccagcgccttaatctctttcccggtcagaagacggctctcacccggtttcagcttcggatccagtgtcagggggcccatggaaagacgttttaaaaagacaacctgacctccggctgcctcaaacatccttttaacctggtggaatttcccctcatgaattgtgagccttgcctcacagaccggttcgccggcttcttcataagaagattctatcagaagttctgccggaagtacagtggtttggtctgccagcgttatcccgcccgcaaacgcctgcacaatatcctctctcagtgttcccttaaccttcgcaaagtaaaccttgtccacatgctttttcggagaaagcagttcatgggccagcttcccgtcgttcgtaatgagaagaagtccctccgtatcaatatccagcctgcctacgggaaacagatcctttcgctttgcatctccaatcagggagatcacagtcggatgcaggttgtcctccgtcgccgaaaccacgccctgcggcttattcagcatgaaatattccatcctggcataggaaaccggctctccgtccatgcagacgccggaaacctccggatcgaatttgaaatcggagctgcggcagactgcaccgtccacggtgacccgtcctttccgaaccgcctcctttacctggcttctggttcccttcttcatctcggccagaaacttgtcaagccttatcattcccgccatcactgccacctccatccgggataatatttgttcttcaagataccgttctgacgtcttgcaaaccccagcggataaccgtccgcgcagacaagacaccatcccctgctctgcgttgtctcctcctcggaaagctgaaccgtctctcctttcagatagcgtattacgcgtccgtcctccgaactcatgtcaaacgtgtcggtaaattcttctttcttcaaatacatggcaagagcctgcgacggctcaaacctgcccttcttaagttcccccagcagaaggcctgtcctgagatatctcactttcttaagataaggcgctccggcaccagagagaggctccggcaggtaatatattgtctcattgacatgatacagacggccgggctcccattccctgtgtgtcagggccagaaactcacggaccggctcccattcctttgtccacttagccggggcggccaaaggcaccggcgctttcctgcttctgcctccgtcctcttccgaaccgcaactgcgtccatcctttttaaggagcgctataaaatgtccctctccccttattttatggggaaagagcctgacgcactcggaaagtccgattccgggctgaaagccatcctgtttttccagtggcaccagatgcaaatcatcatgctctttaagcagacgccggatcgtaccctcgttctcttcctcatcaaacgtacacgttgaatagagcatcataccgccgggccgcagcattttgacggcttccgaaacgatttcgtactggatacggttgtaatactccgggcctttttggctgtagcttttcaccatatcgccgtcgcgccggaacatcccttctccggaacagggagcatcgaccaggattttatcgaagaatccttcaaaatatcgggccagtttttcaggcgtctcactcgagacacagatattgcctgccccggcaagctccagattctttaacagcgcttttgccctggaattgctgatgtcattggaaaaaagcagtccctcgccctggagctttgccgccagttcggtgctctttccccccggtgcggcgcagaggtccagaaccttgtctcccggctccaccggaagaagtgatgcgggagccatggcgcttggctcctgcagataataaagccctgcaaaataccacggatgtctggccagctttaaatcccggtcataataaaatccatcaccggcccagggaatttgtgtcagtttccagccgcattccgccgcaaattgctccggcgtgcatttgagccggtttacccggaggccgtaatggggcggttccgaaaaacaggtcagataatcctcaaactcttctttcagcagctttttcatcttttctaaataatcgctcggcagttctctgtagtccaatgtgtaaactccttttatccgtcattgtccggcagccgtcggcatcgtaactcacctcaaaataacaatctgccaaagctgcttcagtgtaacagttcatgcctgtctgaactgttacgcttagtaattatattttaatttatatttttcaagatattttaaaatccaatagggattaacactcagctcctcataatgatccgtacggatatagatgccaagatgcagatgtacggcaaaattgccaaccgtgttctcctgtttgccatagcctgaatcccccatataaccgagaaggctgccggcctttaccttatctccctgtttcagatccggggcatacgaatacaggtgtgcataatagaggtaggctccggactctgtcctgataccgattctccatccgccctgttccagccagccaatcttttccaccgtaccgtcgctgatgctgattaccggatagaaaccgcgctcccgctccgtgcccattatatcgcagccctcatgcccccgttctccgccgtaggtgcgcttctgcttccagctgtcttcatatacgggaaacggagtgccggctctcgtgctctccggcacaggaaaatacttcaagttttttaaaatcacttcatacgctccggacagtttcttataagccgccggtttttggatcagagccatgctgttatgatacgtcagatccctgcagtctgtcaaatcaaattcatgctccagcatcagagatgtaatctggtcataatccacataatcctggccggcgacagccgcccccagcttcatgctgcgaaagtcgtcgctctcccatgtataggcgttcaactggtaaaatccgggattctgcccaagccagtgaaacatggttgtgttaaaaacggatagtaaaagaaggaatataatgaacataagagaatcgcttccggacatatattatataaaacattctattcggactcttatgaaaaaatccatcctgccggtaatcccggttttaatcctgattctgctgctgatgcgccccgcccttgcctttgacggggctaaatccgggcttcttctatggtttaacgtggttctccccacacttctgccgttcatgctctgctcaagccttctcgtggcctggggcggggttccccttatcacacggccgtttgcaccgctgcttaagctcctgggcctctctgataagggaagctatgctctgatgtccggactgttatgcggttatcccatgggcgcaaaaacaactgccgattttgtccgtgacggcagcatatcaggcaacgagggaaaaagacttctggccatagccggctgtcccagccccatgttcgtcgccggttacatacattctcacctggacggtacggttcctttcctttttatcgcagcagccgtctatctcccggtcataatcaacggctttcttgtacagctcttttacagggaaagaaaaaaagctctcccctctcctttgccggtcacctgcaatgccgctcctgacggcaggccatttgatgaaatcatgatggcttccctggagattatggtcaaaatcggcggatatatcatgctgtattccattctggcaggctttatctgcgaatcctccatactcccggaatcagtaaagccgctgctgaccggatttgtggaaatgacgacggggattgatgctgtctcccggacaatgtccggattgcccgccgccctggcaatcctattctccgccgtcttcggcggcctgtccggcgtatcgcagacaaatacggttataaaaaatgccggactctccatccggcattatgtactgtggaaactgcttcacgcggccctctcctgtactatccttattctgctgtcatctctgtagccgcggcctctccgttgtcttccagctccgtcacaacgctgcctgccagctcgttgcggtttgaggatacgatatcatagctggactgcatggagttcataaagccgtcaaaacgtccctgcgctccttccatggagtgtttgataatggtctggagactgcgcagcatatcgtccgtatactgcacggaactctggcggatattgttggcttcaatcacagcgctgtccacaatggcctgtgcctgtgcgttagcctgctcaataatgctgttggcctcggagtatgccctctgcataatctcatgctcattcaccagctcgtttgtctgcgccgttgcctcggccaccatggcatcggcctgggaacgggcttcctgaagaatggcatcctgattgcttataatcttctgatacttcttaatctcttccggtatccttaatcgaagctctacaagcaactcctcaatctcttctttattaacaagaatctttgcattggacagcggctgatacttacaactgtcgatataatcttcaatctctgtaatgatctgttcaattctgctcatagtctttctccttacttattcgctcctctgcccagcctgggccgcatacttttctctcaccttttcagcaatctccggcgacaggaaagaggaaatatccccgccgtacatggcgacttccttcgccatgctggaacttaaatatgcatatttaaggttggttgtcaggaacagtgtgtctatctcgggtgcaatgaccctgttcatctgcgcaagctgcagttcatactcaaaatccgtgatagcgcgcagtcccctgacaatcacattcgcatcattgctgcgaacaaaatcaatcagaaggccggcaaaagactgtacctccacattgggaaaatgggaagttacgtcttttaacatattaacacgttcttcgacagaaaacaacggagattttgcactattatttaaaactccgacgatcagtttatcaaaaatttttgaagaacgctcaatgatatcgtaatggccgagcgtcaccgggtcaaagctgcccggataaatagctgtcttcatccttacttttctcctttggtaatgaataggtgcttgttggtcttgtactctttttcgcgtacaagctcaaagccaagctcagaaagataatccatcccggtctccctggacgcctccgcgataataagagtatctgcgtgggtaagggctgaatgggccagatattcaagtacagccttctcgagcaattggttataaggcggatccataaaaattatatcaaacacaagctgtctttcctcaaggcgtttcagcgccgtaatcacgtcgcagttcattaccgtcgccttgtcttccagatgagtgattttcagattctcccggatacactgggcagccctggggttatgttccaccattacggccatttcggctccgcggctcagcgcttcgataccgatggctccgctgccgctgaagagatctaaaaaagtgcagccataaacatcattctgcatcatgttaaaaagggtttctttaattctgtctgtggttggtcttgtatccttaccttctattgtctttaaaagcagcctcttggcgcttcctgctattacacgcatggattctttccccgaaaatttttttcttatatattatagtatgtatttcatttatatacaagcagtatttctgaataagctcacttttattgtaatttatcctcacagtggagatttgcatagcaccgctgcgcactccaatgagtgcaaacggtccccgcagcaattcattccgtccggattcccccttacggcaacctgcaatccggggacggaagactcagaaaaacctcaccacaccggccccggtccgttttggccgcgtcctccattctcaatatataacgcaaaaatacagggcaatggcagcattctatctgccgcagccctgtatcttcgccgaaaaattcaagatttctcgaaattataagtcagttgacttatttacctgccatctgtctttcctgagcttcgatcatctttttaaccatatatccgcctacagaaccattctgtgcagatgttaagttaccattgtatccgtttgttaacggcacaccaagttcgttggcaacctccattttgaatctgttcatagcttcctttgcttctggtacgtttgtgttgttgtttgtagtagacataataaacgcctccttttcatctgttttttagtgcccatgttattgtttgtgtgtttgtttcatgggctgttatttatgctacactcctattatggctctcagatgaaataatactctgatatcttttggtacaaatggaatttccttcctgacctatcagtccgcattcatttatgctttacaacagatgtttatttttctttcaatgaaagaaatgcacaaaggttaccgcgccgttcagccgttcttctgtgggaaaacaaaagctggggattacaatatgtgcagatattggtcaccgccagattatcgcctttgattcccgcttcttttaaaacaatctcattagccttccacaagtcaagctgatattttccgttttgtttttttaataatatcacatcatgatatttttcgtgaaaagcatcggcaaactcatctgccacttcttctcctacttcataacaatccccacagatactcggtccgatacaggcaatgatatcctccggccgcgtgccgaatgcttccttcatcgcatcaaccgttacctgccccattctttttaccgtaccgcgccagccggaatgagacaggccgattgctttatgtaccggatctaaaaaatatagcggaacacagtcggcaaaaaatgtaaccagcgttataccgggaatatcggtaatcaggccgtctacatccctgtagtctctgtctctgacaatccccttcccctcgtcctcttctgtcacccgcctgacattagttgtgtgagtctgccatgtcagtaccatgcgttctctgtccacgcccagagccacagccattcttctgtaattttccagcacatcgtccctgtcgtcaccccttgtgaaagagaaattcattgtagcgaaatcacccttgctcacaccgccaagacgggtggaaaaagcatgggaaaccagcccggtatcttcaaggatgggaaatgataaataagtaactcccctgttctcttttacggtcagtaccgtttcttctgtctttttaataattttctgcgtcatagtttcctcccggcagaataaccggctacagccagaatgcatcctgaatcagacgcacctcatcctccagaaccgccactacatcaaaacggcagggagtttcctccccatatccgcgggtcagcaggtaatatctggccgcgcctgcaattctgctttttttctttgcgtcgacggcttccgccggatctccgctccctttgctgctcctgaatttaacctcgacaaaaacaagatagccgccgtcttttgcaatcaaatcgatctctcctgtacggcagcggtaatttttttccaggattacatatccccggtctgtcaggaaagcagccgcctgtaattcatgacggctgcctatctccctgttattctttttatttttactgcgtctcattcttcaaatccatctttgtcagaaagcttctgcggtggatcggacacacgccgaattcccgtattgcatccatatgagctttcgttccatatcctttatgtttagcaaaaccatattcaggatagagcttatcatactcttccatcatatgatcccttgttactttggcaagaacgctggctgcggcaatggacacactcttggcatctcccttgataatcctgacctgctttttatcgtcaatgcccggaatcataacggcatcatttaaaaatatgtccggctcggccggcagctgcgaaacagcctgccgcattgcctcgtaggtagcctgaagaatattaatctcatcaatcactgccgggcttacaattccgacgccataggccaccgctttttcccggatttccagaaacagctcctcacgccgcctctccgaaagcttttttgaatcattcagccagagaattacagcatcctttggcagaacggcagccgccgcgacgacgggacctgcaagcggtccccttcctgcctcgtcaattccgcagataacggaatactcttcgtatttacgttcatattctctcatctgctccaggcgtttaagctcctgttccagtttctcactgctgatttttctcatcttttgtatgtctcccgtcttatacgtatacttaattctgttttcccgctcttccctcttatttttctccgggggcttccgggaattccaacgtgatccggcccagcttcccgcttcggaaatcatccagcagcagattggccgcttttttcgtatccagctcgtttcccttaagcaggcaggaacgggcctgcgctacctccctgagcgcctcatagggatcctctgtctctataccgtaacgctcatttaagtttcgtccgtaatgctttatcaggaatttcagcagttctgccgccagttcctctttgtcgataatttcatcattgatggaaccgataaaagcgagcttaagccccacttcctgatcctcaaaacggggccagaggattcccggcgtgtctaacagctcaagagtcttgttaaggcgaatccactgatttccttttgtcacacccggtttattacctgtttttgtacatgctttgccggcaaaggaattaatgaaggtggattttcccacattgggaattccgacgaccatggtgcgcacaggccggtttaatattcccctcttcctgtcacgctctatcttttcccggcaggcttcctgtaccagcggctgaatctgcttcagtcccatgccggatcttgcattaactttaattacatggaagcctttctcctgaaaccaggccgtccacttctcattatatctctcatctgccaaatccgatttatttaaaaggataatcctgcccttattttttgccagctcgtcaatatcaggattccggctgcctaaaggcactctggcatccaccagttcaattaccagatcaatcagcttaatatcttctttcatggctcttttggcctttgtcatatggcctggataccattgtatattcatttcaatctcctttcacgtgaccgggcgtatcagcccgaaatggcgtaagggacggattctgagccagaccttacctttaatctggccttttttcacatttcccacactggcaaaacggctgtcctcgctgttctctctgttatctcccaggagaaagtactcatcctgtgaaagaagcaccggattctccgcaaggcctgccagggcggcctgtcccagtccgttttccgcatctattcttttatcgtcaatatacaggaaaccatccttaatctgcaccgtttcgcctggcagtcctacgactctcctgatattaaacttattttcttccttttcaaacacaacaatatcgaaccgttttattttaccaaatctgacggaaagacggttcatcaaaacaacctcatcctgtgaaagaacaggatccatcgattggcccgtcattgtaatctgtgtccccagcgagaagacaatgaaccaggcaacggatatcacgacaactatatcgacaatccagtttacaatcagcctcaaacggctggtttcttcgtctatatacattcgcaccctttcactctgcctgccaaaaaactttgtctgctaaaaaagggacaatatacattgtcccttttctttcaagaattatttaactaactctttaactttggcagctttaccaactctgtctcttaaatagttcagttttgctcttcttactttacctcttctgataacttcaatgttctcaacaacaggagaatgtaacggccatgtcttctctacgcctacaccgttggaattctttcttacagtgaaggtttctcttaaaccgccgttctgtcttttaataacagttccctcgaaaacctgaattctttcacggtttccctctttgatttttgcagatactcttacagtatctcctacattgaagctcggaacagtctcttttaactgagcagcttcgatattcttgataatttcgttcatcctggtgaacctccttcaaaatctttgatgttcttaatacgcttcgtaacagaggaccatctctttatttcacagtttattatgataccatatatttcaaaagaatgcaagcattttaattaagcaggtcgcaacgctgttacacggaacgaactgccattgttccttcttgctatttaatcaaaaacttcttttactacaaattttatttcatcattttcttttgtaaaactaacttcgcatgtatatagggtcccctctaccgtcagtaatttgaatgaaacaactccatttcctatatacgtaaactctggctcaggtgcaagttcagcagaaatacccagcttttgaaaatccccctcattgtcgataaatgccacttcagcagctcccgtatctctgtctttcaacaaaacggcgccaattcgctcatatgcattatcggaaacaacttcgtaatccacaatttctaagtgtttatcctgattaaaccggtcagaaaatttactctttatttcttcttccgtccatactttattttcattactttcagaaaaatcaacttccatatccgttaatttcggtggtactgatagtatctgccatttttttcgtacaaccggaaagtgaaaatgtcagaacaagtatacacagcgtttcacataatctatattttgtttgtttctgcatcattttcattccccctgtaaatttcaattttcctctctctgctttttccagccgcgtagtggccgtaaaatatttcctcaccttcaattcattaaactcttcagatactccgcctcttccttggacagcgacgcatcctcaagaagctccggccggcgctccagtgtccgttcgatggacttcctacgccgccatgtttctatatttttgtgatgccccgacagaagcacctccggaaccttctttcccatgaattcctccggtctcgtatactgggggtattccaggaggttatcgtggaaggactcaaattccgccgatacgtcgttattcagcacgcccggcaccagccttgagatacagtctatcattaccatggccggcagttcgcctccggtgagcacatagtcgccgatggagagataatccgtcacgacaagttccagtacacgttcatcaattccctcgtaatggccgcagagaaacacaagctcttcctccgaagccagttctcctgcgattttctggttaaagaccctgccctgaggagtcaggtagatgactctcggcttctttccaatctttcgttcaagatcctcgcaggccgcataaacaggccccggctgcatcaccatgccggctccgccgccgtaaggataatcgtcgacatgccggtgcttgtcggtggaataatcccggatattgacggcctccaccgatatcaggcccttctccatggcacgcccggtaatgcttgtgttcaggccgcccgttaccatctcgggaaataaagtaagaatgtgaaaattcataaataatatactccttacaggtccagaaggccgtccaggatatggaccgtaaccttcccctcctccagatttacatccagaatgcactccttaattgatgggaacagatattcctttccatcgtttccgtctatcacatagacatcgttcgctccggtctggaggatatcctttaccgttccaaagtctttcccctcatccgtcaccaccttaaggccgatcaaatctatgatgaaattctcatccggagcgagactgaccgcatgctcccttgaaataagaagatcttttcctttatacatttcaatatcattaatattatcatagcccttaaatttgactatcaccatatttttgtggaacttaacctgctccagctccatcaggattcttccctttcccgtatcgagaaagacttcctttaaatccttatatcggttcacatcatctgttgtgggaaataccttgacttcccccttgattccatgggtggaggagataacacccaccctgagaaactgttccatcctatttcctgtcctttcactgcctctggaagccgctgcacgcggcatcttttgccggccggcgataacctggacgctccgcgcaccggtcgccgccgtcaattaagaaaagccgtcttcccctgcaggccggcggcttttacgttactgaatctctacaataacttttttatcatctttggaagctgctgctttgacaacggaacggattgccttagcaatgcgtccctgcttgccgattacctttcccatgtcggaagcggcaaccttaagctcaactacaatctcgtcatcctttaccgattccgtaactgcaacttcgtctgggttttcaaccagtgcttttgcgataacttctactaattctttcataccaattcacctcacaggacattactggattccggcgatttttaaaagtttaccaacagtttcggttggctgagcacctgtagataaccacttcttagctgcttcctcatcgatcttgattgtgcttggctctgtgttaggatcatagtaaccaatttcctcgatgaatcttccatctcttggagatctggaatctgcaacaacaattctatagaaaggagccttcttctgacccattcttttcagtctcatctttaccatttttctttcacctccttaggttaatgctgtatagacaatgcgtttcgcatcatactaactcttaatcagaacggaaatttcatcttaccgaacattccgcccaggccgcctccgcggcgtttgcctccccccatcattccgggaagctgcttcatcatcttcttcatctcaccgaactgctttaccatccggtttacctcggcaatgtcaacgcctgcgccgttcgcaatccgtttttttctggaaggattgatgagatccgggttccttctctcctcatccgtcatggagaggataatcgcctcgactctgtccatcgccttctcattgccgtccagatccacgcccttaagctggttcataccaggcatcatcgtcagaatgctggacatgccgcccatctgcttaatctggcgcatctgatccagaaaatcattatagtcaaactcggcctttttaatctttatgctgagttcttttgctttttcttcatccatcacggctgcggccttatcaataattgataatacatcgcccataccgagaatcctggatgccatcctgtcaggatagaactgctctaaatcggaaagcttctctcccataccgacgtagataatcggcttgcctgtcactgctttaatggaaagcgccgcaccgcctctcgtatctccgtccatcttggtcagaatcacgccgtcaatgccaatcttgtcgttaaacattccggctacattgaccgcatcctggccggtcatggcgtccactacgagaagtgtctgatatacgtccacgttctccttaatctcaaccagctcgttcatcatatcctcgtcgatatgaagacgtcctgcggtatcgataatcaccacattgtggccattctttgaagcatgctctatggctgccttcgcaatattgaccggtttatggcccgtacccatggaaaaaaccgggactccctgcttctctccattcttctgcagctgttcaaccgccgcaggacggtacacgtcacaggccgccaaaagaggatttctgccctttgccttcagcttgcccgctatcttggccgtggtcgtcgtcttaccggcgccctgtaggccggccatcatgataaccgtgatctcattgctgggttttaaagcaatctccgtcatctcggaacccatcagtttcacgagttcgtcattgacaatctttattaccatctgtcccggatgcaggccgttcagcacatcggttccgaccgcctgttcctgtacagaattgataaactgttttactactttaaagctgacatccgcttcgaggagagccatcttcacttccttaagtcccgccttgacgtctgcttccgataagcgtccttttcccgtcaggtttttaaatacattctgcagtttgtctgccaagctctcaaaagccatttaaaccctccgttaaagtagatttacaccagtttcagaatatcgttggagatacgtccaatctgctcaataaccgccttgtcctccgtctcaaggaattcacaggtgagggtgttaatctcctccaccagttccctggtcttaaggaacttcccgacgagtcccagcttctcttcgtatccgttcagtatcctgtcgcaccttttaatcatatcatggacaccctgcctgctgatgcctttttctttcgcaatctcgctcagggacaaatcgttgaacacgacatcttcataaattgccttctggtgctctgtcagcaattcaccgtaaaaatcatataaaagaccctgctctacaattttttccatttcaatcacctgacttatcatacaacaggttttatagggtgtcaagtgttttttctttacaccctatatttaaaatgatatattttccttttcagctaaatctcatcctcaactgctcttttcgtacagataaaacggttctttccctctctctttgccagatacatcgcatgatcggcgtttcggtaaagctcctggtaactctgcccgtcgtccgggcaggcagcaataccgatgctgacggacatctccatctcaccctcaccctgtgagtgcttcagtttggacaggatcagctccgcctttttttgggcattttcaatatcggaggtgtccgacatgaaagcggcaaattcatctcctccgattctggccaccggatcataatcacggaaggactggcgaagcagctccccgattctggccagacagccgtcccccgcctcatggcccttcgtatcattgaccatcttgaagttatccacgtcgatcatgaaaaagaatcctttatttttttcttcaatcaaagtatcaactcttccaacgaacgcctcccggttcataaggcccgttaatgcgtcggtgcagctaagggaaagaagattcatctcctttgccttacgccctgagatgtcgataaccttgccgattacaatatccttgttgccgttaattggctgcatcttgcattcgcaccagatccatcctccgtcccgccccaaaagccgcatctctacgacattgcgcctgcagtccctgcggaccgccgcaatggcttccaaagcgtcccccgcatcatccggatgtatcagcccgccgctgaagttacggaaatttccgatactggatctcgcaatgcccagtaaattcgttgcattctgagtcagctgcagtacatcggttttataattatactcgaaaagaatcgtatcggaaaaatttgacagagccgcataccgctcctgctccagcttaatccggcgcccgctttccaatatgaggatatatacaaacaacccggccagaaatgtaagtcccaccagagacattcccattactatcgtatcatccagaagctcggcagacacatttttcatcatattaccatttgaaaagctcatcaggttccatccctttagccccataggaatatttgtcagaaaagcgctgtccggcctgacttcgaccgtcagtgttatgctcgtattgtttttcacagcctcgataaagctttctatcccgtccgtattttcctgtgcattacttaaaatgtcacatatattccgtcctatccactgatcctcatcggtgcaatagagaatcttcccttttgcatcagcgatacagctgaccatatcccccctcatggccgaatatcgttccagctgcttcatcagcttttccgctttgacggcacatcggatcacgccaatcgtctcaccttgtctcaccacaggttctccgagataaaaatagtatccgcctctaacctcggaataaacaagctccgatacggcggaatttcccgccagaagctgctcgcagaactcacgttcctccggctttaaatcggcttcctctgctcttttctcccacttccatgccggaatataactgaccggaaaatcattgtccccatttaccgtggacagatactgattaaacgcttcactctccgggtcaaactccgatgccgcggcaaacttggcaaccgattttatgcgccaggtcatatcggctagatcttcgctgatttttacactctgcgcttccccatactcattcagtgtttctttctctatctgtataaagcgctcattgattttcgcaccgtaattaataaaaatagaataaatcaggacgcaaaaagcggtgacggcaaacatataaaacgcagttttatatctgccgtatttcactttctcctccatgtaactcctcctttacaaaacttctgtactcgtcttctgataaaggcggggacactaaaaaaccctgcagataatcgcagccgactttctgcagtaaatgcagctgttcctcattttcaactccctccacgattgtcagcatatccaactgcttcgccatctgcagaacgcttttgacaacaatctgcctgcgtctgtcttccccttcgcaggcaagaaatcctttgtccagctttaagatatcaagcggcagtatctgaagcacgttcagggacgaatatcccgttccgaaatcatccatcgcacagataaacccggcttttttcagctgcttcagaaccttctgcatcagttccagctcttctactgcgatactctccgtaaattccagctccagttcgtcgtcctctatccggtacctcttcttgattgccagatacgtctccacaaaatccggctgcatcattgtgtgcctcgacacatttaccgcaatacatacggatgtgagcccgcatgttttaaaccggttaatcaaaatgcatattctttcataaatataaagatccagctctgcaatcatgccgtttttttcaaacaggccgataaaatcatccggcatggcatagattcttccgttcctcatccatctgaccagggcttccgctcgatgcgccttctgaccgctcacatccgtgagctttatctgcggctgaagataaaggacaaattcctccttatcaagagcggacctcatctcagcctccatctctatcccggccagcgcttttttcctgagttcttccgtaaaaaacaaaatcctgctgcctcgcggactgacgatggatttccgcgccatattggcccggttcagcatctcatctatatccataccgcagggggtttcaggaatgtagacaccgcttatcagctccacctgataatttttttcttcgaatggaccgaacgaagccagtctgtccgcaagtccgttaaaacgctccctgagtctgtcctgttcatcgagcctccacaaaaatgcaaaattatcgtcactgattcggcagaatgcctcgtcctccctgcagctgtccttcaggcaggacgcccagtattttaatatccggtttcctgtatggaacccgaataaatcgtttatgtatttaaaatttttaatatcacagtaccagagtgagtattcctgtggcgccgactcggaaaaaagcctgccgctctctctcctgaagccctccagattcagactgcccgtaagcgcatcgtaatattgcaggcgcatctttttgcggtaaagctcctctctctgcatcagggaggagagatagaatgccagggtaaagagcagcgtgatatttgcctggttcttgctgaaatttccaagcgtaatcattcccgccagttcactgcccgtaaataccggtgtgctgcaaagagatgtgactccttcctgcttcagaaattcatagttttcaggatcggaatccttcattgcttccgtatctgtaatcagaatctgcgtataactgttgaaaagctccccgtattccctgacaaaagccgacggaatcctgccgggcctccatttaccggattcccgcctcccccattgtgtcaatatctgatgttccccaaacctctgaaccgttccccactcagcgccaaaaaaaggacagatattatcaaggatccgtctctgtgttacatacaaatctgtttcatgaagcatcggctgaatacaattcatcagcatgttttgtccttcaagactctccgaaagagctttaagcaccgcctcatggctttttagggcagttgctatctccatccggacaatatggccgtcaaaatccaccagcttatcttttaatatgtaatccgtatttaaatgagaattatggtatgtccagatataataatgctccctggaaagaagatgattggtgcagaacgggcagggttccaaacgcccctgaaggatttcatagcacttctccccccggtactgctctcttctcagttcttcagaaataaacgtttcatcactgatatacaaaatctcatacgtttccggatcactgaaatatacaaatgattccggcttctccatcatcaggatttcattaatagtccgctgataccgtttcatgatatcaaaccctcttttcagtctatatccagattgctctctcacagtcttccttccttctcttgcgtacgtttagataatcttagcatcaaacgattttattgtctaccgttccgacaataatagaagagcctccttccgatttttgtataatttgtataattcgacacggaaggcagttttttatgcatttccggtcatcttttgtccccggccaagggaagtcagggctgccttataaaagaaaaagcgaaacagccgtagccgaacgaaccgaatgtttttatgaatatcgtactatttttaatgttaatcattaattttttattgactttcatatcacatactgctaaactgtagttatagaaaacgaagcacaaaacggttcggcaaaagcgcagcccatgccggctgcctaaaacggatattacaaaaaaggaggactcaatcatgtcaaaaaacggctccatgaaagaaagaaccttagataagctgcgcgaagaaagcagtactatctatcaggggacccggctcattgtatttttgaatgcgttattcgccataacgtgtatcattatgctggttctcagttttgttttcagcagtaccgtaacggagatgcgcagtgatacggcgcaaaggggctttccatttatcgtccacacatttgcctatctcgtaacctcgggcgatgtgtacaccgaaacaggtgcttttaattacggctattatattttgtccatggccgcccagcttttctccgccggcatcattgcgtatattttccacactatttccagagtgtttaaatctattctggacggcggtacaccgtttgtagatacatgcataacggagtggaagcggtgttaccgttttttctccctccttaccatgatctactttcttgcatcttttattttaagaccccttatcctggcaatgatatcgccgctgctggccgcctgttttttctattctctgagcctgatctttgagtacggcgcccagcttcagcaggaatcagacgaaactctataaggaggggattttatggcaatcatattgcgcctggacagggtaatggcggatcgtaagatgtccttgaatgagctatcggaaaaggtaggcgtatcaaatgtaaatctttccaaaataaaaacaggaaaaataagcgccatacgcttcagcacgctgaacgcaatctgcgatgccctggactgccagccaggagacattatggagtttgcgcgcgatggagatgacggtataatctattaacgctgcctgcacgctccgagcataggtccaccgcccttaatacaatatggccgggagacatttcaataactgtctcccggccattaatcagactataaccccatcttttttaggaatctttttatatattttgcgataacaaatcatgtgagcggccgccgtaatgagccacgaaatcggatacgatatatataatgaaaaaagcgtatggtggtaagcaaaaatggtaaaaatccatatcacacgcagtccgcaggctccggtcagggataccaccatgggaaggacggaatatcccatccccctgagactgcccaccagcgtatccatccagccgcagataaaataagtcgtgcagataatggacatccggagcattccataagaaatcacttccggatccgaagaataaattttcagaagatccgttccccctatcacagccaaaaagccaagggccattcccaccgccgtcaccgtgccaaggcagataaacaggatccggtttacgcgtgtgtacatgcgggcgccgatattctggcttgtgaagcttaagttcgtctgataaagggcgttcatcgccgtatatacaaaaccttctatattggcagaagccgtattgccggccatggctatggaaccgaaggagttgacggacgactggatcaggacgttggatatggagaaaatcgccccctgcattccggccggaagacctatcttcattataagcagcgttttcctcttatctatcctgagtttttttaaatgcagcttcagaggtccgtccgactgagccagacatttaagcacgaggcctgccgatacgcactgggataagacggtggccagggcgacacctgccacgtccatgtgaagctgtatgacaaaaaacaggttcagtacaatattgacaacaccggccagggtaagaaaatataacggccgttttgtatctcccaccgccctcagaatggcgctgccgaagttataggccattaccacaggcattcctgcaaaataaatcctcatataaataacggatttttctataacgtcttccggtgtccccatcagctccagcatatatctggaggtaaaaaggccgaggaacacaagaatcgctccgctgaccagactgatggctattgccgtatgtaccgtctcactgacatccttctcgcttttcgccccgtaataccgggcaaccagaacattggccccgattgaaagtccgataaatatattgatcagaaggttgataagagccgtcgtggagccgaccgccgccagagactggcttcctgcaaaacgccccacgacaatcacatcggccgcattaaagagaagctgcagtacgcctgacagcatcagcggcaaggcaaatgacaacacctttttaagaatcgggccgctgcacatatccatttcataagacttcttcattctctgctttcctttcctgtaatcgcattataatacttcaaaaccggttttgaccggccaatgtcatattctactgctgcttcaggagtaatgcaagtagtttttacttaatttttacacattataattctttcatcatctggccggcattatcagcagccctgacttttgaaaatgcttttacaatcacacctttttcatcaatcagatacgttgtcctgactactcccatcacctttttgccatacatattcttttctttccatacatcataagcctcgatcgcggttctgtccggatcggcaagaattgtgaaaggaagattgtatttctccgcaaattttctatgggactccaccgtatccttgcttatcccgataatctccgcatttttctcaatgaacgcgggatatagctctgcaaatgagcatgcctgatttgtgcagcctgccgtattatccttgctgtaaaaatataatatcactttctttcccctgtaatcagacagggaaacctcttttccttcctggttcttaagagtaaactccggtgctttcattcctggttccaacatgattgatacttcctttctcttatatattttcacactgttgtttttaacacactgatagtctgcgccaaatcggcgttttttaaatcgccatttcagtttttcaccgtttgatttcgccctctccaagcaaatcatatataatggaagcaaaaatgacggcgccttttttgagtactgtttcatccacatcgaaccgtaccgtatgctggggcgatgccatggcagtcatagtccgcatatagactgcctgtcctccctgctcctgaacccgtttcatcataaatccgatatcctcgcttccccagttctgaacattgggattgctgctcaccgtatactggggaagatgctcccttaccatgccggcaatccgctcaatgaacaaaatatcacttgtctgggaaggagcgtgtcccatcagctccatctcacaggtgcagccctccatcattgccgcggcccggcagatctcgattgccctctcttccatatatgcgttaacttccgttgtctcgccgcgcacctccatggatatcaccgcctcatccgccaccacgttgctgcttgtaccgccccggatactgccgacattgacccgggtgatcccgccgctgtgccgtgaaattccggccagccccaccactgcatgggccgccgctaaaacggcattcctgcccatttccggaaaacctccggcgtgggccgatttgcccctgaaatacacgtcatacttacaggtggcaagtgaaccatacgttcctggtgttatgtctccgtcgtctgccgaattatccggagccacatgggttcctgcaaagtagtccactccgtccagatgacctgcttccaccatcgcatttgctccccgtacgccttcctcccccggctggaacagcagttttacggttccgtgaagctgtccccggacagaggccaggattctggctgtgccgagtccgatagccgcatggcagtcatggccgcaggcatgcatcattccatgattagcggatgcaaacccctccctggcaggcctgtgtttctccgatgtatcctcctccatcggaagggcatctatatcaaatctgagggctgcaaccggaccctctccgcagtccagaatcccgacaactccggtatagccctccgccatctcaccgttcagataatcgatatatccaggcattccgtcttcatttccgccatccattttccgttcgatcgtcgcctcggcttttactctcctgtaatgctcctccaatatatcattcccaggcaccgacagcctgcttccttcccggcagactgcttttccggtcagaaccttataaccgagccgggtcagctcctccgcaataatggcggaggttctcatttccagccacgccgtttccgggtgtttgtggaaatctctcctgaattccaccagcttttcctgaatcgaatccccaatctgagtgatttgggcatacatgtctcccttcggcttaagcgcctctttcggtgtatataaatctgcttccctatttgtttccatatattttttatctatctcctttaatgacgtattttcatttattagtctatcacattttatagtaaatggtaaaaattttgtcggttttctctgaattttgtgatatactgttaaaactaaaacaaatgaaaataccggaggttttttaaattgaatcaatctgctgcatccatccatttaccaactgatcccaacagtaattcaaagagccatgcggattctttgaacaaaaaaatcatgattatcggttccacctgcgtggatatcataataaatatcgaccacctgcctaaaactgaagaaaatatccatccaagcagccagtcgctggctttgggcggatgtgcctataatgtggcctccatggtcaaacaattcggtgttcctgtcacactgatatcccctgtcggaacgggcttctacggagaatttgtggcaaaagaactggagaaaaacggatttccggtcgccgtccatgtacccggccaggaaaacggatgctgctactgtctggtggaagccggaggagaaaggacatttatgtcttatcacggcgctgagtatacattccgaaaggaatggatgacgccctttgacaagtacagctatgatatggtctatgtctgcggactggagattgaagaacccacgggtttagatttgattgaatatctggaaagccgtccggagcgggaactcttctatgctcccggtccgcggggaatacggattggtaaggaaaaaatggagcggatttacgcactccaccccattctgcatatcaatgagctggaatctaaggagttaagcggatgcacttccgcagaagatgcggccgaaaagctctgtttccttaccggcaacacggtaatcgtaacgctcggtgaaaacggcacctattgccgcgaacgctccggtatcgcctatacggtgcccgggattcccactgccgttgtcgatacaataggggccggagactcccacatcggagcggtgatggcctccctgagtctgggaaacagcctgagaaaatctattcatatcgctaataccgccgcgtctgccgtggtcggtgtaaagggagcttccttaacggaaaaagaattccgggaaatgtcaagatgttggggtcaaaaggtcttttgaccctggtaacagaaagactgcgctttcgcgcaatctttcttcttactttatctcatacaaccagtttttttactgtcttggattgtccggacaaacgttccagttccatctgtcccctgtacaccctgtcggttgcaagttttatattgtgcagatgcttttcaataaacatgattcccgccgcataccggttaatctcctctatcatatcctcggtcaggcggatggctcccatgtatattatattagttctggtccggttccacagagactttggaaagtgaaatccatgctctgccaaaagaagtcccaggttattcactgaaatcctgacagaagaacgcagcctctcttccaaagaccggcagataatatccgtaaattcaaaacacgtctgaagttttctgcgtatatcctcacgctccatcaggtaaaacgtatcatccattccggactggcgccttatctccatatccgccataaacatcaggtacagcttctcccatgattcaattgacaataccgcctgctccatgcggctgcaaaggctcttcatttcctccatctgaaccgcacgtttgcgaagctgggccctggtcccatccagcatcttgttttcaattcccttcagctcaaactgagcctttttcagccgttcatccaggttcacctgtatccggcagtcaatatgaggccacatttcttcatcagcagacagactttcgagatttttcatctcatgctctaaaagcgttttaaccgcttccttcagtcctgccttttcattcccggaaattttcttctggctgcattcgatcatatgccctaaaatatcccatacaacctcttcggcaagttcccggcactgcgcacaaagcagctcggccactacgccgcagcacctctttaccttttctatttttgcctcttcactctctataagcaatttttgtttcactatctcacgttttaattcttcaattctctcaatggtatccatgcttgttctataattctcccctccgctgccaaatgcgaacaaaatatcatcccagaattagcgccagccataagcaaccttttgaaagtagattataaatcaaatgaaatcgccgtatgagagagtacgcttcgcgcacacccatgttaatcagcgataacctgcacgctccgcgaacagatcaccgccatcaataaaagcagataccaaaaaaggcatctgcttaacgggtatccaaaatgattgcaactggctgtcatatacttctacttagaccctttagctttgcgccaccgcctttcgacgggtttgccaaatataatatttgttagtagtcattatactttattttatttggaagtgcaaatggtttctttgaaaattaccaggaaatttaagaattgttccaaagagtgaggggagaatcagtgaatcgggtgaaaatattatccgtaattggataatattctgatagtgcttccgtatccgttctcctttttttataggccggcacgaagaatgataggaaatcacaacataccttctccataccagcctataggaaatccggaaaatcattccgtaaacgagatgctccgtagcgatttttacatctcctgcagcacccacaacgcataatccacatatacattacaggcaatcagcaggccgttttcatccaggtcaaacaggccgtgatgatggggaacccctgtattcggttctgcaggattgtgggtaccgacaaaagcgtacatcccctttgtcaccgccagataatccgcaaaatcatcggctcccagggctttctcataatcactgataatgtcatcttccggaagaatcttttcaacgacagccctgacctcatcaaccgcccggccgtcattgacaagaggcgccgcataatcgcgaaactctacttctgcctcggcgccataaagcattgccgtctgtttcgcaatccggatgactctgtcattcgtgaattttctcacttccggaccgaagctccttgtagtaccctctatctcagcatgctccgcaacaatattatactgtgttccggctttaatcacacctacgcccacaacgactgtttcgagcggatctgtatttctggctacaatgctctggagtcccacaacaatctgggatgcaatgtaggcggcatcaatccccaaatgcggtttcgacacatgggcgcccttgccggtcacactgattttaaaataatcgcagcttgcattttgaggcccttttgtcagcgatatcttccctgtcgtcaggccgctggtcacatgggttccgaagacccggtccacgccctccagcagtccggcacttacaaactgtctggccccctgcccgatctcctccgcctgctgaaagaacagccggatatgtcctgcaaattcacctttttttgcgttcaatatcttcgccgccgtcaaaagcgtggccgtatggccgtcatggccgcaggcatgacaaaatccttcattctgcgaacgatattcctctgtctttaagtcttccattgccagcgcatccatgtcggcccggagggcaatggttttaccttcgcccttctctccgtcaatccaggcatatacgcctgtttctccgactcttttgtgcaaaagaccaatcttatcaagctcttcctctatttttttacacgtattatattccttcaggcttacttcaggatgagcatgaaaatatcttctcaggctgacaaggtaatctttttcatctgttacatactgctttaatgccattttaccctccatccgtgccggctagtacagcattgcacttatttcaaaatcggcagttcagccgacgcagttattcagcgtcatcccatgcgcagatgaaagcgccctggtattcgtcttcaatcgtcttttttacttccggtgtatggtaagcgtccacaatcttcttatacacctcgttatctctatcggctgtgcgggcagcgattacgttaatcaactggggaaccgcctcgtttgtggaaggatctacattttctgtatagatagaatcttcaaccggattaagtcctgccgtaaatgcatttcctccattgataatagctgccgcacagtccggaagaatattggccagtgttgcagattcagcctccttgatgtcaattttcactttgtattccgtgatgtcagcctttgtcggtacatagcctttttccggatcacacacgataaaaccggcttcctcaagcagtttcagggcgcgtccgccgtttgtaagatcgctcggaattgcgattacatcgccatctttaatctcttcaatagaagaaatctttttcttattattgtagatggaaagaggggcgataatcgtgtcgccgatatctacaatgtcatatcccttctgggccacatcatttgcaaggaatgctttgtgctggaatgcattgagatcaatctcaccgtcatttaatgcacggttcggagctgcatagtcggtaaatttcatcagttcaacctggatgccgtcatctttcagcagttcattgatcgtgtcccactgtgcgttgtattcccctacaacacctacttttaccgtagttacttcagccggttctttcgctgcttcacttccggctgcctcactgcccgccgctgcggtagaagccggcgcattgccgctgcctgaactgcagccgaaaagtgaaagggctgttacggctgcaaatgccactgctgctgtttttttccatgatgctttgaatgtttttttcataattttctctcctttttctaattaaaatatatttaaatattactatttaaaacataatcattccgtccggagcagaccggccgttacttctaatgggtcgttttcctgattatcaggtttccgataaactggatagcgctgataatcaaaagaataatgataaccgtagcccaaatcatgtcgcggtaccccatctgatagccataccggatagcgaaatcgcccagacctccggctccgatggctcctgccatggccgtaattccaatcaggctgacaaaggtgatcattgtgacacgggtaatccccgggatgctttctttcagataaactccgaaaatgatttcaaccggtgagaagcccatcgcctcgctggcctcaatcaggcctccgtccagatccgccagaaccgattcaatctgtcttgcaaaaaagggaacggttcccgcgatcagggccacataagagccggtaacaccggagccggttccaacgatagcccggctgaccggaatcagcaaaaccatcaaaataatgaatggaatggaacggatgatgtcgatggctttatctaaaaagttatagattaccacattctgtaatattccgcctctctttgtcacaatcagcaggaccccgaaaaacaggccaagaaaaaatgcgatagtacctgatatcagcagcatcttgaatgtctgcccgatacatttgacaagctctccgcccaggcgctccaggttcggggctaaactgtataatatattcattctttaattacctccacttctactcccagtgagtttatgtactccattgccttttccatcttatccgcctcgccgcttaaagtcaccaccagcttgccaagcggtttccctttcaagaaatcaatatttccgaaaatgatattggcccggatatcaaatgccttagcaagataggaaatcagcggctcccccgcattggcgccggaataggtaaaaagcagcattctgtcaccggctccaatctgtgtcaattcatttttatcctcaattaaatcataaatcttcctgatattgcttgccgtatctatgaagtcccgggtgatccgtacctgagggtggctgaatacatccacggtatttcctgcttcgaccacggtaccctcctccataatggcaaccctgtcacagatatctttaacaacagccatctcatgggtgatcagcactattgtaattcccatctcctcatttacctttttgagaagcttcaggatggactgcgtcgtctgcggatccagtgcgctggtagcctcatcgcagagaagcaccttcggatcattggctaaggctcttgcaatggcaactctctgtttctgtccgccggaaagctgtgacggataggcatcccgtttatccgtcagacctaccagctccagaagagacgcgattttctcttccctctcattcttcgtaagtttcgtctttttaagaggaaattcaatattctgatagacagtcctggaacgcatcaagttaaaatgctggaaaatcattccgatttttttccggacttctctcagctttttttcatccaaatccattaagtccacttcatcaatcagaacacgcccctgcgtcgggcgctccagaaggttaatgcacctcactaatgtagattttcccgccccggaaaatccgataataccaaaaatctccccgtcctgtatttccagattaacgtcttttaccgcatggacattaccggatttggtgtcaaatgttttactcacctgtttcagcttaatcattctttactcctttcgatttcctgttccgtaacagttcagacagcatgaaccttcctgtcttttcaatatcgttcaggaagtctccttccatcattatttaaaaaccgggatcaaaaaaagctcccgccctgtattaggacgaaagctgctgcttcgtggtaccacctaacttcgtctgacgctcacgcaatcagacctcttcaagtacggccggacatcgacaggccactttcgcggcttatctgggaacggtttatactctatcgctgtaacgggcgcaccccgtcatgatctaaaatattcgaccatgcaactctgagaccatcttcataagcctatctctgctccctctcagcatccgggaactctctgtaaaagcatccgcttactactcttctcttctacgtctttgctggtaatcaatttatcaacttgcgattatattattgcattttttataatttgtcaacctttttttaagtaattttgcttcggatgagcaaaacggggtgatggagatttaactgaggtttggaggacgcgttcagaacggacctggtccggtgtggtgagggattctgtctgagtcttccgtccccggttggaggttgtcgtgtggggggaatccggccggaatgaattgctgcagggaccgtttgcactctttggagtgcgcagcagtgctaagctcgtgagggacctcgctaagcaccggcggactcccatgtcccctccgcaattgattccgcctacttccccggggcaggttttcgccgtggacggaagactcaggcggaggttttcgcggcaccggacatgatccgttccgggcgctgattgtctccaaccttaaatggggaggaccctgtcgcggccgctacgtgtttccgcaggctgacatcaaatcctccacaattttttattgcaagaatagcaaaaaagcggcacaaaaggccgcacaggtctttataccgtcatacggaaaccttgatttcatgcgggtttgcgcgtgttgccttaaaacgcctcattacgctttgcaaggtgcgattgtaaagttgggcggcttaaaacaaaaacagcagaccctttctttggcctgctgacagctttagtataccacaccttccctgaaaccacaagaggcgggacggggtttgcggacgggcgtgggcagaagggacgggcgcggacaaatggagccacccaccccctgacagaatgggcctctgcggacgcggaaccgaaggggcctgtatcatttcacccgaacccctgaaaaggggcttctatcgttccgcatgacagccccggtgtgagactgaaccacatctcatgccggggctgtttccatgcgcggcgggaatcccaatcccaccgaaaacaatcgtggcaagcagtgcatgagcgtacacactcctgcaaaacgcttgttgggtgctggaacccaaaccccggaaaagaaccgacagtggcggtcttttccaacgcccctaacggggcggctgcgcgtcctgccggacgtttcaaaccacgaggcatatccctgttgattaaatctcccgtattcagcgcccgcaagggcgcgtagccgctccacctgtggagcgtttggcaaggcagcgtaagcggcccttgccgggggattgggggcggcccccaacaagcggattttcggagaaaatcgcaagtgcatatgcacttgccctgcttgccgctattgttttagcggaaacgccccttccccatccggtacggtttcccccgtcccgtccgggacgagtttcagcagcacggaggcgtagaacataccgcctttctgctcaaactgcaccgtgccgccgtaccgggcggcgatctcccgcaccgaggccgccccgattccggccccctcccgtttggaggaaagcggcgtgtccccgtcgaacaccacgggcgtcacgcacgaattgtccaccagaatcaaaagtgtggagctgccccgccgctttacccggagcttgatggtctgcggccccgccgcctcacgctggcaggcttccaccgcgttttccagcaggttccccagcagcaccgtaatgtccgtgccggacaccgggcactcgtccgggtagtctatccccgcctcaaacctgataccgctctcccgcgccgaggccgcgtaaaagcaaacaatggcgttcaccacgtcgttacagcaataccgctcccaaaaatccgggggcagctggttccgaaacaggtcgatgtattccgcaagccccgccttgtcgtcatgctctaggtacgactgcaccaaggccaaatgctgccggaggtcgtggcgggccttgcgcgtgtcgtccatgtgggaggccagcgcgtcaaactgctttttctgcgccagcaggctacggtcggcgtactttaacgattcttccagctgtgtccgggcgcgggaggtttccagcactttaagccccacaaaggacgtataacaggccccgaacagcatgaggtaacgggataccataaactgccaagtcgcgtaggcgtacacgtccccggtaaagcaatagagcataccaaaaatcgtggggaacagcgggacaatccagaatcgccgccacatctccccgtcgtttattttcagcgcgtcggtcacggtatgggtgaaaaaccggagcagaaacgggcaggttatcaggtagatcaacacgcgggcgatgttataaatcaagtatgggtgccggtcggaaaaatcccaaaagaaccggctttcaataaagttggcgttgcccatgacgaaaaactgccacgccagaaacagcagccatgtaaacatgagctttggaaaagtgtcctttatgagcaggaacgcaagggccagaaaaaccagcataaagccgtagcgtatggccgtcgtccaccgggccgccgcctcgtagccgcccaaattgatatagaaaaagacgccgctgtataccgccgtcaacaccacttgcagcgccacgatctgccggaaaggaatacggagcctgtcgcggcatatccagtaccggggcagcgtgaagggcagggaatcaaggaatgggaacaaaagcaccatcagcgcgtcaaccgtgttcatcataatagcgcgtcctccctttcccgctggaacagataggcgctatacagcccttccagctttttcttctcccgccgggcaaaggggacgcttgccccgttgtccatcaggaacgccagcccgtcgattcgctccacccgttccgcgttgacgatacagcccttgtagcagggcaaaaactgtgggtagggggccagcagccccgccagctccccgaagggcagacggaaccggaggacgccccgcctgtcggtatggatttgggtatagtgttcgtacttgtcgcaacagaggatttcacggagcagcaccttttcctgttccacccggacaaaccgggcgtttcgtatcttctccaccccgcaaagctccattgtcttttcaaagtcgccgtactcgtagggttttaccagatacccagaggcccgcaccccgtagctctcgacggcgtggctaacgcttgtggtgacgaacaccagcgccgccagcttgtccttctcccggatttgaccggctgtgtcgataccggaaagcccggtcatatactggtcgatgaaaataacgtcccacccttccggctggaaacgggacaaaaaatcctccccgcttgaaaactcctcgacggcgggcgtttccccggcgtaatgttcgtttaagtattggtgcaggcacttccttaaatcctccctgcacgattcaaggtcgtctatgattgcggctctcatgtccaaggccccccttcttatcacaaagcatttaacttgtcaagaccattttaccgcaaaaatcccgtttcgacaatgcaagttacggccaaaaatgtcaagttgcggccaccctcttgaaaaacgccgcttttttccctatcctgaaagtgtagaaagcgatctggacaggaaggaggccgcgtatgtggagcatgattgtctgcgacggtgacgaagcagagcgggagcagctaatggatttggctcgtgggtgtttggaggaaatggaggtggaggcagaggtcacgggctgcgccgactggccggagctggacggcatgacgcggcgggggcttccggacgcggtaatcgtggcgcaagacagcgtggagggcttaaacaccatcaccagcgcacggctcctgtcccggaaaatcatctggttttccgatctggattttggggtgcaggcgtaccggctgtgtgtgccgttcttctgccaaaagcccgtgacgcgctacaagatggagcaggcattgacgcggtttatggaggtaaaccaaggggccggaaaagcataggattttcaaatagcaatcaagacggtttggaaggggggatacccccttcccgtagctccaaaggagctacgggaaacgtcccctatccgaccgcatacgaaacgacaggagggaatgattttatgttgaaaaaaggaaaacgggtagtggcgtcgctgctggccgccgtgctgctggtcgggcagctgggagccacggtttacgccgaggggccgcccagcgacgccgggggcctgtgtgaacaccacgcggcccatgacgatacttgcggctatgtggaggccataccgggccgcgactgcgaacatgaacacacgccggagtgctacaccgaccagctgatttgcggactggacgagggcgcggagcagacggccacggacagcgacgcgggccaccggcacgggcaggagtgttacgcgctggactgcccccacgagcgtggggagcatgacgaggcttgcggctacatagagtgcgtagcggggacgccctgcggctacgtctgcgatgtgtgcaataaggagccggacaaggacagcggaacaaccagcgggaacacgcccgcgccggtggaaccggagccgggaaccggggagccggaggacgcggggacgatcaccgtcacggcctttgacgagctaaacgaggcggtgaaatatcagaccgtcccagcgggtacgaggctggacggcctgaccctgcccgccacactgggcatgtccgggtacgccgcggccgacgacaccgaaccagccccggagccgatcaccataaccggcgtgacgtgggagccggatagcccgtgggacgacaccgccgaacagggcggctatatctttactcctgttcttccagccggttatgcccgtgcggacggcgtggagctgccggaaatcaatgtactgatcggcggggccgccgtcacccttgacgcgcaaggcgacgttctgaccgtgacctttgacagcaacgacaacagtagcatgagtagcggcaacgatatggcaacggccatcgacgccgcccttgccgccctcccgcccgacagctacaaaaacattaccaccatcaagctcaccggaggcgcggacaagattaccgggtataactggcggtatctgattgaactgtacagctataatagcgactgggacagtctgaccgcccttgatttgtctggcatggcgggccttactgctgtgagtgataatgtaagtggtggtacgtattctcgtccacaactaagaacgctgaccctcccggacagcctgaaaaaaattggggaagttgcgttttatagctgcgagaaccttaccttgaccgaactgccaaagggcgtgacacaaattggggattctgcgtttgacgactgcacgagcattaccctgaccgaactgccaaagggcgtgacacaaattgggagtggtgcgttttacaactgcacgggcattaccctgaccgaactgccaaagggcgtgacacaaattgggacttttgcgttttccggctgcacgggtattaccctgaacgagctgccgggcggcctgactgaaattggggcttatgcgttttccggctgcacgggtattaccctgaacgagctgccgggcggcctgacacaaattggggcttatgcgttttacggctgcacgggtattaccctgaacgagctgccggagggcgtgacacaaattggggaggctgcgttttacggctgcacgggcattactctgaacgagttgccaaagggcatgatacaaatttgggcttatacgttttacgactgcacgggcattaccctgctctcgctgccgtccggcgtgaccgaaattagggagcatgcgtttgagggctgcacgggcattacccatattatcatggaacccaagaccgcacccatgctggaagccggcgtgtttagcaataccagccccgacctgaaaatctatattccatctgatgggaacggatatgacatctggagttggggtagcttgaccactgtgaagtacacccccataacaagcattagcctttccaaaaccgcccttaccctgacgcggggaggaattgaaacattgaccgccacgctctccccggatagcgccacattcaaggacattatctgggagagcagcgacaccaacattgtcacggtagatcaaaacggcaacgtgaacgccgtttctaacggcacggccacgatcaccgcgacctcacggcaagggagaaaaacggccacctgcgccgtcaccgtggaaaccgattccagcggaaacagcaacgggggcggcgacggaggcggcgataatcgtaattacatcatcaccacgccccagccgccgaaacccaatacccccgtgctggccgtgattgagctgcccgttaccgtgggggacggcacggccaccggcaagccggacgacgggcgcacggcggcggccatagccgaggctgggaacaaggccggggccaagcaaaacgggattgccgtacagtacgacgcgaaaacgtccaagacctatgacggcttttcaatttccttacagcgggccacccttgaccggctgatcgacgccaaggtgaagtacgtcaccttgaacaccggcattgtggatttgaccttcgaccttgccgccctgaaagagattgcggcaaaatccaccggcgacattaccctgaccgccgccagagaaaccggccttgccggggacgcgctcgccgccgtgggcaagcgcccggcctaccgtttgaacgtgagctacaccggcaaggacgacaaggcggccaccgtggacagcttcggcgcgggccgcgtcaccgtggggctggcctacgcccccgccgttaccgaacaggccgggagcctgtgccttgtttacagcaaggacggcaaggacgtggaatggctgtattccatctacgaccgcaccagcggaaacgtgatcgcgtccgtggggcatttcagcgtgtatgccgtgggccaccggcccgccccggcctttaccgacacggtgaaccattgggccaagccggatattgactttgtggcaagccggggcctgttgaccggcaccggcgaaaccacctttacgccggacggcaccatcacgcggggaatgttcgtgacggcattgggacggctggccggggtagatcccaccgcttatacttccagccggtttacggacgttgccgccgatgcctactatgccccctatgtggagtgggcggcctccaaggggattgtgaatggaaccggggaaaagacctttagcccggattccaccatcacacgcgaacaaatggcagccattatgcagcggtacgccgacaaactggggtgtactctcccagtggcccgtgaagcggacattttcgcggacgaggggcagatcaccagcggcatgaaaaacgcggtacaggcaatccagcaggccggtattatgaacggcaagggcggccaccatttcggccccaaggacaccgccacccgcgccgaggccgccgtgctgcggcgattcgcggagttcgtcatagaccgggccaccgctggcggctgggggcagaacgacgccgggaagtggctgtactacgaggacgccaagcctgtcaccgactggaaacaaattgatagcaagtggtactacttcgattcgtcgggcctcatgcaagccgggggctggcgtgagatcggcggcaagtggtattacttctacccggacggcgctatggccgtcaataccaaaattgacggctacgagatcggctcggacggggcaagaaaagaatagcaaatacacaaaggaaggcactgcgggatacaaaacccggcagtgccttccttatcttctcataaccttctttgtcaatccgggcaccatttcgcctgaaataacgctgtccacagcgcaaagcaaaatgccggtaaatccagtaaccatgcggatttgcggcctttttctcttgcattaagcacactgaaaagggcgcgataatttactattttttataatagacccatcgaaggcatatcgtatttcccgctcacggaagctcttagtggccgcgacaaggtcagccccccgcacttaacgcgtgagacattcagcggccgcagtccgaaccacgataatctccctccgggacgaaagactcatatacacaccccgccaccccgtccgctggccgtaccggcggcgtcctcacctgcttaactaaatcctataacagtgtcccggccagcgaatgtatgttcccttttcttccgttttgtggtattctaactatatatactgaatttaattaaaatcccaaaaggaggttctctcatgatggatcagctctcgctctttgataaccgtgaaactacgtcccctcttgcaagcaggagccgccccgacaccctggacggctttgtggggcagaaacacctgataggagaaggcaaagtactgcgtaaccttatcgaaaaggaccaggttacttccatgatattctggggccctccgggagttggaaaaacgaccctagccaggattattgccgggaaaacacgctcctctttcatcgatttttccgccgtgacaagcggaataaaggaaatcaaaacggtaatggagcaggcggagaaaaaccgaagcatgggaattcggaccattcttttcgtggacgagattcaccgctttaacaaggcccagcaggatgctttccttccctatgtggaaaaggggagtatcattctaatcggcgctaccacggaaaatccatcctttgaaattaattcggctcttctctcccgctgtaaggtctttgttttaaaagctcttacagcgaaggagctggccgaactgctagccgctgtggtaaaatccccaaagggctttgggaaccagcatgtgcaaatctcgaaagagcagcttttctttattgctaattttgcaaacggagacgccaggactgctttaaacaccctggagatggccgttcttaatggagaattggaccgttccggaacactcagcgtcacaaatcaggtgcttgaacagtgtaccaacaaaaaatcacttctctatgataaaaaaggggaagaacattacaatcttatctctgcccttcacaagtccatgcgcaacagtgatcccgatgccgccgtttactggctggcccgaatgctggaggccggagaagacccgctctatgtggcccgcagactgatccgttttgccagcgaggatatcggaattgccgatcctcaggccttaactcaggttgtggccgcctatcaggcctgccacttcatcggaatgccggaatgcaccctgaatctgactcaggcagttgtctacatggccatggcgccgaaatcaaattcgatctacagagcctatgaggaggcaaaggaggatgccggaaccatgatggcagaacccgttcctcttcaaatcaggaatgcgcctacccggttaatggcggatttgcattatggtgaaggatatgtctacgcccatgaaacaaaagacaaaatagccgctatggactgccttcccgcctctctaaaaggccgtgaatattaccgtcccggaacaatcggcgccgaagccccggtccgggaacgtcttgaagaaatcaggaagtggaggcgggaacatcccgccctcccgtaggctgttcagattctatttctgtcatccatcagttaaaaccagtcattacggcaatgaccattgccgccgatgcaaacacaaacagcactgcctggaatttaatctggaattttgcccacttgccccagtcgagtcttgccgcagccagcgctcccagcagacatccggatgtaggaacaataaagttactgaatgcatcgcctaactggaatgcgaggacggatacctgccttgacacacccacgatatcggcaagaggggccataataggcattgtcagcgccgcctgaccggaaccggaaacgacgaagaaattgaatatggtctggaatacatacatcagccatgcggacagcatcggcgggaaattcttcattccctctccgatggaatggagtatcgtattgagtacggttccctccgtggcgctggttccgccaaggataataataattccctgagccataccgacacacagcgctgcccccaaaagctccgccgcccctttatcaaatgattttgcaatgtcattcactttcatatcgttcagtttaaagacaacaccgataataccggatacgagccccatcacaaaaaactgggaggcgatctccgggatataataaccttcggcaataacgccccagattgtccatgccatagtcaggacaatcgtgaggataactagcttatgaccgaaagtaaacggcacatcttccttatttttcgatgaaaaatcatcgcggtaatactgatcggtttcatatgccacggaagactgcgggttctttttaatcttcaccgcatagcgcattgtaaatatgattgccgtcgcagtaaaaatcacccagaggacgattcgaaagccggcgcccgacatgaccggaatacctgcgactccctgggccacggcaaggctgaacggattcatccaggaagagccaaagccgatctgtgtcgccacatatgaacacatgatacctactaccgcatcatagcccagcgcaataaaaagcgggacaagaatcatgacaaagggaatcgcctcttctcccattccgaaaacagcgcctcccaatgaaaacaacgtaatcaggatggggatcagtagtatttcccgcccctccgtcttctctatcaccttcataattcccgattccacggcgccggtccgcagaacaattccaaatgctccgcctactaccagaataaaagcaataattccgaccgcagtaccattcttatccccaacggtcatgccttcaaaaacgaagtttaaaattccctggcctccaaaatcttcggttccgaaaatgggagccgccttcgtcactttattcccgttctcatccagcacataccggaaactgtcgggatctaagacggttctggttttctctgaaccattctgcatataggtgatttcttttgtttcatactgtcccagcggaataaacagggttaacactgctgccagcacaattacaaagaaaataataatatacgtgtgcggcatctgaaagcttttctttttttccatctctcatacctcttcttttagtattcaaaggtccccctcttaagaacctctcctccggaaacaaccgtctcacctccggcgataaccgtatcaatttccagtgtatccgaagcagacagcaccagatcggcgtctgcatattcggtaattcttcccttgcccttaagttttaacagaaatgccgggttggaagtaacggtcttcagcgcatcggcaagccgtacaccgtcctttaacaccgcatccttcatttcccggtacagtgaagatacttttcccacgccaagatgcctgaaatttcccttttcatcgaaaaccggaaggctgccctgcccgtcggaggaaaaggtgatatggccggcatccacacctgcatccagcgccatcttaagcccggctgatgcctttacctcatccggatccagaaaatcaggatcggaactggttgtcaaatcaatatatccgcccagccgtctggcgtaatcgattccgtccgacatcagggatttatttcggttaatatgggtcggcagcatattggatgccggaatctgggactctctcaaaagccggcgcaaataatccagctgctcccggccgtctcccatatggatattgacaatcccggctttgccggataatatgcctcccactcttgtatcagcgacaattctggcaaattcctcgtacgttggctgggatgagcggtgatctgaaattgcaatttctcctgtgcctattactttatcaagcaaaataaggtcatccgccacactgccggtcaatgtcctgaccggtatctgataggaacctgtataaatatacgcagtaattccttcttcctccagtcctctggctttggcaatcaggtttgtcatggttctcgttgtgccgtctgtccccagacagcccactactgtcgtaacacctccgcagataatatccgacagcataatttccggtgttcttgtcctgtatccgccttcaccgccgccgcccagaatatgcacatgggcgtctatcaatcccggcatcatgatttttccgctgccgtcgattacctcaacatgataagcctcttctgcgggcagtgattccccgattctaagaatctttcccccgccgatcagtacatccatgcatcccaaatcctccggtgcgtacagacgggcattccggatcagtttcatagctccgttcattttcctgttctccactcttgtttttattatagaagtaactgcaaatccaccgcctggttaccgtaccattcccgatttcacagacacactccggcgcaaattacagttcatattattttatcacatacatgatagaatgtcatagatttttgtattattattctggctgattttacgaatattgtaaaaatcttcatcagctccagccattcattcaaacacgacacatgcaagacgtaaaacaggacagaaccttattcatggggttctgtcctgttgccttgtaccatataaacctgtagtgtaaaattatgtaaatacagcaattctttctgattattattgaaattaataattttcttttctaacctcaaaatagctctgcggatgagcacataccggacatacttccggagctttcttgccgattacaagatgtccgcagtttctgcactcccacattgtctcttcagatttctcaaatacagctttcatctccacattatttaagagctttaagtatctctcctcatgcgttttctcgattgccgctactgccgcaaatttagctgccagctctgtaaagccctcttcctccgctacttttgcaaattcagcatacatatcggtccactcataattctcgccttcagcagcagcctttaaattctctgctgttgttccgattccttttaattccttgaaccacatcttggcatgctctttctcattattagccgtgttctcaaaaattgctgaaatctgctcatatccttcttttttcgctacgcttgcaaaatatgtgtatttatttcttgcctgtgattcacctgcaaatgctgtcataagattctgctctgttctgcttccctttaattccattgttttattcctcctatgttttcttctgattttaggaattattcctgtttttatagtacactcttttccagcatttgtcaagtggtcgggtgaaatattttggagatttagttaagcaggtgaggacgccgccggtacggccagcggacggggtggtgggatgtgtatatgagtctttcgtcctgggggaggattgtcgtggttcggggctgcgggcgaagataaagtctgcggagcacgctcccgctctgtgaaatgcatcgcgctgctaagctcgtaagggacctcgctaatcagcgatggatttcaacggcatccgcagactttatcttcccctccgccccaagggcagatatttcgccgggacgaaagactcaaggccaagggtatcgcccgtccgctggcctgcggccgctgaatgtctcacgcgttaagtgtgtgggcggaccttgtcgcggccactcagtgctaccgtgtacgggaaatacgatataccttcattgcgcctttataaaaggcgctagatttggtatctgcctgcggaaacacgtagtggccgcgacagggccctccccatttaaggttggagacaatcagcgcccggaacggaccacgtccggtgtcgaaaacctccgcctgagtgttccgtccccggcgaaaaactgacccggggaagtaggcggaatcaattgcggaggggacatgggagtccgccggtgcttagcgaggtccctcacgagcttagcactgatgcgcactccaaagagtgcaaacggtccccgcagcaattcattccgaccggattcccccctcacgacaccctccaaccggggacggaagactcagtcatccccctcaccacatcggacatagtccgttccggacgcgtcctccaaacctcagttaaatctccagcttctcccccaaaatctcattcaccttcccgggattcgccttccccttcatctgcttcatcacctggccaaccagatagctgatgacttttgtttttccgctcctgtattcctcaacggtctgcggatttgccgccaggacggcttctatcgtctcttccaggatactgtcatcatttaccatcagaagtccgttctctttcacatactgttccggttcaatatcctctttgaagattttttcaaatacttcctttgcgattgttgtattaatgctccccgactccgtcagcttgatcagcgaagcgagatgtcccggtgagaagataagctggtcggcttccaccgcattttccttcatcagccggctggtttcgcctatcagccagttagccgtttttttcggaaggccgcacaggactgttgtctgctcaaagagatcggacagttttctggattctgtgataatgcggctgtcatacccggacagaccgtattccttctggtagcgctccatcttctccggctgaagctccggcagggagtttctgacctccctgatccactcttcgtctatcaccaccggcaaaagatccggatccgggaaatagcggtaatcctttgcatcctccttcgagcgcatcgcaaaggaatactctttgttgtcatcccatcttctcgtctcctggataacacgcttcccggcctcaaggatttctatctgccgcagtttttctccctcaattgcacgggaaatagccttgaaggagttcaggtttttcatctctgtcctcgtaccgaggccgtcacttcctgcctcacggacagaaagattcacatcggccctcatggagccctcctgaagcttgcagtcggaagctcccagatattgaatcagaagacgcagacgctccagataagcaataacctcctccgcgctgcgcatatcgggttccgatacaatctcaatcagaggcaccccgctgcggttgtaatcgaccagggaacagtcctcccattcgtcatgaatcagcttgcccgcatcttcttccatatgaatctcgtggattctgatatcttttctgccagaagcagtctcaatcgtgatatgcccgtcatggcagagcggcagataaagctgggaaatctgatagttctgcgggttatccggatagaaataattctttctgtcaaatttgcagatcctgttaatctcacaatctgcggcaaggcctaccgagagcgccagttccacaaccttcttatttaatacgggaagagaaccgggcattcccgtacataccggacaggtgtgtgtgttgggagcggctccgaatgcggtggaacagccgcagaatatctttgtcttcgtggcaagctccacatgaacctccagaccaataacggtttcatactgcttcttcatttattttccctccttatccggccggcagccgctaatcgggagttcccaccggccgcgtgccttttcataggccgacgcggcccgaaacagtttcttctcctcaaaacagccggcaatcatctgcagcccgatcggcagtcctttttcatcggttttacacggaacgctgatgccgggaagaccggccaggttgactgataccgtataaatatcacccagatacattttcaggggatcgcagagactctcccccatagccggagccgtagacggggcggccggtcccagaatgatatcatacttttcaaatgccctgtcaaaagcctgcttgatcagcgccttcgtgcggagcgctttcagataataagcgtcatagtagcccgagctcaatacgaatgagcctaacatgatgcggcgtttgacctctgtcccaaatccttccgagcggctctttttatacatctcatgaagatcctcatactccccggtcctgtacccgtacttcacgccgtcgaaacgcgacaggttggagctggcttctgcggatgcaatgacatagtaggccggaatcgcatattccaccatccccagatcaaagaactccacctcagccccctgggatttcagaagctctgccccctgcagcactgctgttctaatctcatcgtcaaggccctcgcccagataatcggaaggaatcccaatcttcattccctttgcctcgcctgtcagcgcctccgtaaagttatagtcctttctcggcaccgaagtactgtcctttttgtcgtgggaagccagaatttccaggacagccgcgcagtcggccgtgtcccttgccaccggccctatctgatccagagaagaaccgtaagcaatcagaccgtatcgcgaaactgtcccataggtaggtttaatcccggtcacaccgcagaaggagctgggctgcctgatggaaccgcccgtatcggagccaagtgcataaaacacttcgccggatgccacggcggcacaggaaccgcctgatgaaccgcccggaacatgctttttgttccacggattggcagtaggaccgaaccaggaagtctccgttgtgcttcccatggcaaactcatccatatttgtcttgcccactatgacggctccggccttcttcaggtttgtgaccgcctgtgccgaataagccggtacaaaattgtacaggattctggagccgcaggttgttttcatgccctctgtgcatatattgtctttcaccgccatcggaacaccggccagaggccctgacagcactccggcgtcaatgcgcgcctgtatctcctccgcattcttaagcgccttttcctcttccagcgttatgaaggcatgaaccgtttcttcactctcacgtattcgggaaaaggatgcctccaccgcttcttttaccgacactttcttttcttttatctgttttcccagctcaagtgctgtcaattctaaaagtcccattatttcctcctgttctccgccgtcagcggatagaacgcgcggcagcccgccgtttgccctattctaccgtacgcggcacctgatactgcttatccttctgccggggcgcattggacagcatctccccggactgatccccgtttgtaatctcatcctcacggaaaacattgcttatatcgaagatatgggacataggagctgttccccgggtatccagttcattcagcttgtcaatatattcaagcattctgctcatgtcctcaccggctttctttttttcttcctccgaaagattcagctttgccaggattcccacgtattctattattttatcgtctattttaactgccatattctttccctctttccttttctcctttaccctgcccgccgcctgccaagcttatggtacgagacggctcatatccctcgggaacagcgacacttccctcacgttctcctcacccagaagctgcatcgtcatgcgttcaaggccgattcccagtcctccgtggggaggcatgccatatttgaatgtgtttaaataatcatccattccttccgtatccatgcctcttttctcaatttttgcaagcaactccctgtaatcatggatacgctgtcctcccgtcgtcacctccaggccgcggaacagaaggtcaaagctcctggtgaatctgggatcctccggatcatccattgcatagaacggacgttttttagagggatagtgtgtgacaaatacaaaatcagcgccgtattcttctttgaagtaacgtccgattaaatgctcctcctccggttccagatcatacgggtttttaatgacggtaccatacttttcagccgccagctctttcgcctgcgtaaatgcaatacagggaatctcatccaccttcggcagctctgccctgagtaatccaagttcctgaccgtattccgtcctgagcagtgataccatatgctgaagaaaacccgtctccattgccatgatatcggtaaaatcgtcgatatagcccatctcaaaatccagccctgtgtactcattcaaatgacgcttcgtgttgtgcttctccgcccggaataccggcccaatctccatgacacggtcaaatacgccgaccatcatctgcttatagaactgaggactttgggccagaacggccggccggtggaaatagtcgagtttaaagacgttagcccctccttccgctcccctggctccgattttgggagtatggatttccgtaaatccttcaccctgaagaaattcacggaatgcccgggcaatgccttcctcaattttaaaccttgcgcgctccctcacatttctcagcgttagaggtctcatatccagcctggcttccagggatgcccccatcttccattttgataccgcaatcggcaccggcgcttccggccgcgagagaatcctcacgcctgtcaatcgaagctccacgccatgaggcgctctctcctcgggttccacaaatcctgtcacctcaacaaatgtctcttctttcagctgtgaaagctcagccttcgtcactcccttctcaaacacggtctgcaaaacgccgtcccgttttctgagaatgatgaaagcgatatcccccatattcctgatattcataactgcgccgtttactttaacctcctgccccgtcttcccatacgataaaagacttttaagctccagaacttctttttcttttcttcctgttaaaaattccatctcttttcctcgctttcttctttttattcgatgttccgtccggacgtttaaataaaaaaagtcccggaacatctttcgacattccgggacgggatattcccgcggtaccacccgcatttgaaaagtaaagcagcgcttatatcttctcactctcttttatgcttaacgcgcatacacgtgacgacctactttgaagcttgtttcgggcgtccggctccggagtgttccctattgttttattccctcctgacgcggctctcagccggtgaccgcatctttctgtcggattctttaaaacagagtctccttcactgcctttacatgaaattttatggtcatcactatataccatttttgaaaacttgtaaagcactttttgaaatttccagaaatttctccatctttttttattaagaattttttaaatgcgttgacatccggccgcctatgcatataatttacctgtataaataatatcagatacgcttttggggcttatcggatacttaccgccagacagggataaaagcgtggtctgagaaccttccgccgccggtcgggtgaaaaaatttgttcatgaaatcaattactgtatcattagacaggaaccaaaaaacggaggaaaacatatgtgtggaattgttggttacatcggagacgagcaggcggctccaatactgctgaacggactcagcaagctggaataccggggctacgactcagccgggatcgcagtttacaatggaacagaaatcaagatggataaggtcaccggacgcctgcagcgtctaaaggatcttacaaaagaaggaagcacgctccccggaaccgtcggtatcggccatacccgctgggcaacccacggcagtccgtctgataccaatgcccatcctcatttcaataaagatcgctcgatcattgttgtccataacggcatcattgagaattacagcaaattaaaacagcgcctgatcggcaaaggctacgaattcgtatcagaaaccgataccgaggtactggctcacctgctggattattattacaagcgcagccataacccgcttgaggcgctcaccagggttatgcagaaggtggagggttcctatgccctcggcatcctcttcaacgactatccgggccaggtcttctctgccaggaaagacagtccgctgattgtcggccacagcgaaagcggtaatttcatcgcctccgatgtcccggccattcttcagtatacaagggaagttttttatatggagaacgaagaaattgccgttctcagccgtgacggaattaaattttacaacgtggacgaggaaccgcttgaaaaagaatgcacccgcatcgactgggatgtcaatgccgctgaaaagggaggctatgaacacttcttcctgaaagaaatctatgagcagccaaaggcaatccgtgacaccatcagcccccgtatcagggaaggtgaagttgtcattgaggaactgggcatgacagatgaagacatctgcaatattaataaaattatgatcgtggcctgcggctccgcttatcatacaggagtgatggccaagtatgtatttgagggaattgcaagagttcctgtggaagtggatctggcatctgaataccgctaccgcgatccgatttttgaccgcaatacgcttgtcattatcgtaagccagtccggagaaacggcggattccctcgctgctctcagagaatcaaaagccaacggccagagagtcctgggaattgtcaatgtggtgggaagctctatcgcccgcgaggcggataatgtcatgtatacctgggccgggcccgagatttccgtcgctaccacaaaggcatacagcgctcagcttgcatccttctacctgctggccatgaaattcggaaaagtgcggaaagctctggcggatagcgactatgaacagatgattggcgatctccagcagcttcccgggatgatggaggaactcttaaaggaccgccagcagattcagagatttgccaaccgttacctggccgccgagcatatcttcttcatcggacgcggtatcgactatgccatctctatggagggttccctgaagctcaaggagatctcctatattcactctgaggcctacgcggcaggcgaattaaagcacggcacaatctccctgatcgaggaaggaacgcttgtagtggctctcgcgacccaggaagccctctatccgaagacagtcagcaatgttgtggaggttaaaaccagaggagcttttgtgatggctttgactaatgaggataatacggaaatagaaaaagtatctgactttactgtttatatccctaaaatcaaccgttatttttccggttcgctggcaattatcccgctccagcttttcgcctattatgtatctctcggcagaggccttgacgtagacaaaccaagaaatctggctaaatcagtgacggttgagtaagtcggaataagtgctgaacacagaccagtcggaacgccttcggatcttctgagtttttttaaaaacatagaaggaaaatattgacattctgttttatttatgtatactattgatattagaaaagcaaaggcgcttcggtataaccggagtgcctttttttcagtgcgcccggcggcgcacgtctctaaccggtgaaagtccggaatccgcccggtggtgggaaggatatagccgaaggcaagggtgttcatcgtgaggtgaaatctgaaggaagccggatgtggggaacatactaacccatgggcaaatctctggtctgacggacagaaatcacatcaggccatgcgtgagggtaaggctgctgaacaagtcgaagcccaataaccacacggaatcacgtatggtaaatgtggcagatagatggagagaaagagacgtgtggtacccggggaggtctgtgcggaatgtcctgaaagggataaccattatcgaaagatagtgctgaacgtacagaagtcagccgaggtcgtagtagtcgagagatgaaggaccgaatcaacaggagtctttagtacaactgggaaaggaggaaagaacattgggtacagaaaacaaagatagctgctcgcaaagagatagcgcggaacgtgaagggtatgtgagagcgcaccgttctttccgccggatatggaaggaaagggacagtgcacagccggaactcttggaggagatactggagaagggcaacctcaacagagcttttaagagagtaaaggcaaacaagggagcgccaggaatcgacgggattaccgtggaggaaataggcgcatacctgagggaaaaccagaaagaacttatcgagagaatcagaaggggaaagtacacccccgacccggtaagacgagtggagattcccaagccagacggcggaatacgaaagctaggtattccaaccgtaaaagaccgcattttccaacaagccataacacagcgccttacaccggtctacgagccgttgttctcggagaacagttacggttatcgcccgggaagaagcgcgaaagatgccattcagaaggtgaaagagtatgcagagcggggatatatccatgcggtagcattggacttgtcgaaatactttgataccctgaaccatgagatactcctgaatatcctgcgcagaaatgtgagggacgaaagggtaatccagtggattaagaggtacttaaagagtggcgtgatggaaaacggagtagtcatggaaacagaagaaggttcgccgcaaggaggaaatctttcccccctgctggcaaacatctatctgaatgagtttgaccaggagtatcagaagcgtggagttgtatttgtccgttacgcggacgacatcgtgctgctggcgaaaagcgagagagctgccaagagactgctggagacgagcacgaaatatctggaagggccgctgaaattgaaagtgaaccaagagaaaagccgtgtagtcagcgtgtttgcaatccgaacttttaaattccttggctttacattgggaaagaacggaaagggcatatatgtccgggttcatggaaagtcatggaagaaaatgaagtcaaagctgaaagaacttagttcccgaaggtcagttcagagcatacgccctgcattagcaaagataaaagtgtatatgtgtggctggctgaattattacgggattgcggaaatgaagaaccgaatagaagaactcaataagtggctataccacagaatccgaatgtgtatatggaaacaatggaagaaaccgagaaccaaggtgaagaacctgcggaaaatgggagtgccggaagatttggcatggcaggcaggaaacagccggagaggatattggtttaccacgcaaacggtagcggtaaatatggcaatgacaaaagaaagactgataagcagtggcttttatgatttagccatagcttatcagtctgtgcacgtcaactgttgaaaccgccgtgtaccgaacggtacgcacggtggtgtgagaggacggcggttaatcaccgcctcctactcgatttcaattgcagggcggtcagaggttctgcacggcactgaatctgaaaggagacacgattatgaaaaaatgtattcccgagctttatggaagtcttgtattcaacgacaaaatcatgaaaaacaaactcccgggagatgtctacaaggccctccggaaaacaatcgagacaggcagccatctggaactggatgtggctaacgccgttgcggtcgcaatgaaggaatgggccgtggaaaatggagccactcattttacgcactggttccagccgatgacaggcattactgccgaaaaacatgacagcttcatcaacccggtcgggaatggcgaaataatcatggatttctccggaaaagagctggtcaagggcgaacctgatgcatccagtttcccctcaggcggccttcgagccacctttgaggccaggggctatacggcctgggatcccacctctcccgcatttattaaagacggcacgctctgcatccccaccgccttctgctcttacagcggagaagtccttgataaaaaaacacctctattgcgttctatggaagccataaacaaagaagcgctccgagtgctgaagctatttggcaatgaagacgtcacccgtgtctactcgacagtcggtcctgaacaggaatatttccttgtagataaacaattattcaatagccggaatgatttaaaattctgtggcagaaccttattcggcgcgccggcccccaagggccaggagatggacgatcactacttcggcgccctgaggccccgtgtctctgcttttatgaaggagctggatgaagagctgtggaaattcggcatcccggccaaaacaaagcacaatgaggtggcgccgtcacagcacgagctggccgtcgtttacacgactgccaatctggctgctgacaacaaccaactgaccatggaagtaatgaaacggactgccgaaaagcacggccttgtctgccttctccatgagaaaccatatgagggtatcaacggaagcggaaagcataacaactggtctctttccacgaataccggggtcaatcttctggatccggacagggagccggcgaaaaacctgcaattcatgctgtttttagcagcgacaatgaaggcagtggatgtatacggcgatcttctccgcgtatcggtggccaccgcgggcaacgatcaccgtttaggcggcaatgaggctcctcctgccatcgtttctatgttcatcggcgacgatttggcctctgtccttgatattattgaggcagatgccgaatcggaggcaaaggagacggttaccatgaccgccggtccgaaagtgctgccccactttgtaaaggatacgaccgaccggaacaggacctccccgtttgcctttaccggcaataaatttgaattccgcatgccgggctcctccctctccgtatccggaccgaatgtaatcctgaatactgcggttgccgattcgctcggagcattcgccgaccggctggaaaaagtcccggccggcaagctggaggaggaaatccacaccctcttaaaggaggtgatccgggctcaccggagaatcgtcttcaacggcaacggatatacggaggattgggtaaaggaagccggccggcgcggcctgtttaaccttccggcctgtgccgacgccttcccctgtttcattgcagaaaaaaatattgatctttttacaaagcaccatgtatttacccgggaagaaatcttctcccgctatgagattatgcaggaaaattatgtgaagacaatcaatattgaggccaaaacaatgtgttccatgatgtacaagacgttcctgccctccctgctctcatacatagaaacaattgccgaagcgacggaaaaaacgaaaaaggttctcccctcagcgcctgtcatctcccaggaaaaattgttaagcaccctcgcccggctttatacttctatttcagaaatgaccgaagaactgaagtcagccattgccggcgccgattcaatcggagattccatggaaaaagtaaggtattttaattataccgtacttgccaaaatgaatgggctgcgcagctttgtggatgaagcggaagccctgattcccgaatccttcctcacgtatccgacctacgacaagcttcttttttccatatagtgattaagtgacaatgattcagggaggatttaaggtcatgcagccattagaaatacagacaggaatcaaagaagagtgcggtgtttttggaatctatgatccggagggcggcagcatttccacggatatttactacggtctcagcgccctgcagcaccgggggcaggaatcctgcggaatcgccgtcagcgataccgcggggccgaaagggctggtcctctgccgcaaggggctggggctggttaatgaggtgtttgcagaggaaaccctcaaaaatctgacagggaacatcggcatcggccatgtccgctatgccactaccggtgccggtaccctggaaaacacccagccgctcgtattaaagtatatcaaggggactctcactctggctcataacggaaaccttgtcaatgcagcgcagcttcgcagagagctggaagagacaggagccgtattccagacgacaattgactctgaggtcattgccttttacattgcaaaggaacggctcggcactcccaccgtggaggaagccatcaaacggactgccgcgaaaatcagaggggcctacggtctggtcatcacaagtcccagaaagctgattggtgtccgcgatcccttcggactgaagccgctctgcctgggcaggaataaaaacatatggatgattgcgtccgagagctgcgcaatccaggctgccggtggcgaatttgtccgggacatcgcccccggggagattgtcacgattacaagggacggtctgcactccgatatgagcctgaagcaggagtttcatgcacactgcgttttcgaatatatttattttgccagactggacagccggattgataacgtgagcgtctatgagtccaggctgcgcggtggcgccgctctcgcccgctcttatcccgtacaggcggatctggttgcaggcgtgcctgattcgggacttacggccgccatgggatatgcaaaggcatccgggattccctttgaaatgattttccacaaaaacagctatgtcggaagaacatttatcaagccaaaccagaaagagcgtgaagacagcgtgaaaatcaaattgagcattcttgagccggctgtcaggggaaaaagtattgtcctggtcgatgactcgattgtccgcggcacgacaatcaagaacctgatccggatgctgaaacaggctggcgctatccaggttcacgtaagaatctgctctccgcccttcttatatccctgttattttggaaccgatgtgccttccaacaagcagctcatcgcatacagccactccgtagacggaatcaggcaggaaatcggagccgattccctggggtatatgccggtcggggatttgaatgaaatggcgggcggccttgcgctctgcacggcctgctttaccggaacatatccgatggatgtgccggacggagaaatcaaaaacgctctcgagcaatcgggatgactgcgtgcgtcttaaataataacatttgattttattggtaaaagctactataatcaagccaaagataaaacttattttgttcaaatagcagaggaacaaagaaacaccctctgtctgaagaaaggagtgattatatggcacgattcttatcaaatttaggagaagcaggtattatattgaacattgcaatcatgcttgcatccggttttctgctgacccgcattaccaaacgcctccgtctgcccgatgtcaccggttatatcatttcaggcgttatcatcggcccatggtgtttaaaactaatcgctccggacttcattgaacagatggattttgtcacggatctggccctggccttcattgcattcggagtcggaaaatattttaaactttcagcattaaaagcaaatggaaaaaatatggtaatcctgactctgtttgaagccctgatagcaggtatctttattaccactgccatgcttcttatgggactctccctgtcgttcagcctccttttgggtgcaatcggctgtgcaaccgctcccgcctccactatcatgaccatccggcagtacaaagctaaggggccttttattgatacgattcttcaggttgtagctttagatgatgccgtagccctgatagccttcagcgtctgtgctgcatttgtccaggctggttccaaaaccggtcatatttctgccggacaaattattttaccaataatattcaatatttcagcgcttggtgtattatcaggaattctgttaagctatgcaatccacagaggacacagcaaagaccacagcctcgtccttgcctgtgtctgcatcatgggcgtggcgggaatctgttcctccatggatgtatccccgctcttagcctgtatggccaccggtactgcctatattaataccagcggcaataaacatttattcaaacagatagatcagttcacgcccccgctgcttgtgattttctttgtactttccggaatgcgtctttctattcccagcctggcagcggccggaatgattggactcgtctattttctggtgcgtattgccggaaaatatgtcggctccacgattggcgccattatcaccaacgcttcctctgagatacgcaggtattttggactggcattaatcccccaggccggcgtatcaatcggacttgccgtactcggccagcgtatgctcccgtctgacagcggaacactcttgtccactatcattttatcaagcggtttattgtatgaaataatcggaccggcctgctccaaactggcaataaaaaagtccggaagtattcctgttaaggaaaataaatagggcgacggagcagacagcggctgaattatgctttaattgttaattcggttagccgctcctgctcccctcagctcccatgcaatccgggcactttcttccaattcttctaaattgaaaaaagcatccataagactgtctccccctgcaacaggaccatgatgtgcgagaagatatccattttctttgccggtccgtctggaaaattctgagaacagctcttcgcttcccggtttttcgtaggaaacaagacgtacttttcccagcttcattcccaaatacggcgtataggcgggaattacatcatcttcctctcccttgtggggaaggcaggaccacagaacgctgtaaaagctgtgaacgtggatcacggcctgtacttttccttctgctttctgatacattgcaagatgaaggggaagctccttgctgggctttttcccattgagtacattgccgtttctgtctgtcaccgcgaaggaatcttccgtcaaacagccaaaacaactgcctcccaccgtaatgtaaacacgatccttatataaaaagctcatatttgctgaagagcctgaggttttgtttctttcaaacagactcctcccaatccagcacgcatcggacagccgtcttttcagctcccctgtttcctgtgctttcgtcatatcaaatgctcttgagaagaaatcatcctgaccaaagttcccggattttaaggccatacgaatgttctggttgtgtagcggaatcaatacggggactcccggggcaatgctttcacctattataaaggcatcaaaaccaagggccagagttacggctcccgaggtttcgccccctgcaacaataatgcgggtgtatccttcatcaaatgcctttttccccagctccgccatagttttttccaatatttccgatgccgccgcagcctgggactcgtccgcatatttccggctttccggatccgtggcacctgcactgtatattaaaaattccttatccggatttttcaatatctcattccatatattttctgtagtctgaactccgcgaagaccttcggacgggtaaacggcaatcgccggattattctcccggtaggctctgcactgtcggcatgtggcggtactgcagcttcctgaaagtgcaattcccttcccctccgtccaggtcggaaggatattctcgccctgacattcatattcctctctgtattgggcggcaagatgctccaaaattcctgaaccgcctgtcagcagacgttcctttccaaatacttctgcaatcttttgcccctgattatccgttgtataatccggaatgatatagaaatgagagttattttcactaaactttttcacttcctccataatcatttcttcggaacatgaaagcagctcctcaccgattatcatgcagggatattttccctgcggcttcatcagggcggcaagctccgatgcccaaatagggttgaggggatgatgtgccatatgaccttcggcaataggctttccatccacaatcagaaccccatcctttacaattctgcggttaaccggaagtgacggacagagcagtgtatatggaatctcatatttttccagcgcagcatcgataacgggacctatatttccctcaggggtcgaatcaaaggttgaacaatatttaaagtaaaactgttccgcaccatgcgccctaagccactcaagagctgccagagtatcacgcactgcgccggaggctgcaatactcctggtcttcagggcaataacaaccgccgcacagtcacgcacaacctcggtatcttttggaattccgttaaacagaagtgttttgattccctgtttggcaagaaacgaagccgcatcactggcgcctgtaaaatcgtctgccacacatcccaaaagaatgtgatctaatttttttttcaatgaactatctcctttactgttataaatttaaaacaggctgcagaactagtaggcccagcctgtgaaagccggaatgtaggtgacaagcatcaggacaataaacataattccgataaatggtatcagcgccctgctgatttgggggatgggaaccccggaaacattggatcccacatacatagccgtccctaccggagggctcagaagtcctatggtcaggttgataaccataataaggccgaactgaaccagatttaccccaatggatgttgcaaccggacacaaaattggtgccagaagcataatggccggtccgctgtcaatgaacattcctgtaatcagaagcagtatattgataagcagaagaagcaaaaatttattatcggtcagtcctatcatccagttggtgatcttggccggaatctgctcgctggtcagaagccagctgaacagggtcgtagccgcaatgattgtcccgatggtggcactgctctctgccgcctccagaagaatcccgggtaaatccctgattttaatttctttatatataaacatccccacaagcagtccgtacaccgagataatggcgcctccctcagttgccgtaaaaatcccgcctctgattccaaatacaataatcagcggcatcatcagtgcccaaaccgcgctcttaaatcgtctccatatctcatctctgctgacggcattctccttcggatagtttttctttttaccgatgacgtagcagtaaattaaaaatcccattccaatgcagattccgggagcatacgccgccataaataaatcgcctatcgatacgttagccgtgcaggcgtagataatgatcgcgattgatggaggaataataagcccgatggaaccgcagcaggcacatagcgcgcctgaaaatggcctttcatactttctttttgtcatctccggcaccataattgcccctatggctgcggcgtccgcgacaccggaacctgatattccccccataataataccggtaattgccacgaccatggcaagcccgccgcgaatcgggccgacaaagcagaggcagaaatcaatgatacgcttcgtgataccgccgtggctcattaaagctcccgcaagcataaacaatggaatcgccatcagcgggaaagaatctactgcggtaaacattctctgggccagaaccgtaatcggataaccggcgtgtccgattgccgccagtgaactgactcctaaagcaaatcctacgggcagtcccataaataagaaaataaaaaataatgcaaacagaataacacctatcatgcgttctgatccccctttctaaataatcggtataactttaaaagtataaaaaagaggcttattattccgcatataggaatacataaataaatataattcatagggattctcatagtagcgcttttctgtttttcaccgacctcgcacagcttaatcccggcataggtaacggctgagaaaaaaagagcgctgaatatgtagatgacagcatataaatttcttccggactttccctttaaaaatccgggaagaagatccaaggcaacatgcttatctgcggcaatgcatctggccataccgataaaaacaatccatacaaacacataccggcccagttcttctgaaaaattaagtgccgtatggaatacgtaccgcactaatacagcggcaaatatatcaaccatcatcaggaacatcagggctgctaaaaagcatcccgtcacattcatgattcctctttccagttttttcatctataaatcctcctgattcaggggcgggtatcagtttttacagcattgacgcattttggcacccgccctgaattttcatgatcagcggcctaaagtttcctgaattttgttatataaatcaagttgtccgatgcttttggcatacttcggggcaacctcatccgctattttgataaatccggaaatgtcaggatctgtgacggtaacgccctgattttccaccatatccttaaggttttcctctgttacccgtttcgtctcctggttctcatattccgtcgcttcctgagccgcctgcatgataatcttctgctgctcctccgacagtttggaataggccgtatccgacatggccatagtcacatactcatatttgtggttggtgttggcaatatatttattaacttcatatattgaacctgaatagaagaacggaatcggattttcctgtgcttctatgactccctgctgaagactcggatatacctcagaccagctcatggttgtagcggctgctccccacgcgctgaatacctgttccatggcactaatctccgggattcttattttcagtcccttcatatccgctacactgttgattggcttactggaggtaataagacgcgggcctctctcccaccagttcagaatacggattcccgatgtatccagaacatgagccgcaatctcttttccgacgtctccataaataaccttttcaaattcctcgttactgcggaacaagtacggaatctccagaaccgatatggtatcgtcaaaattacttaaaactcctgcaataagtgagatatcaacggttcccatcatgagcccctctgccatatcccggtcaccgcccagagtactgttgggataaatctcaatctttatatccccgtttgacagctccgacacgcggtcggcaaacttgacggcacccagattccatagatccgactccgactggatatgtcccagtttcagtacaactgaagcactgccgctatttccatcctccgcactgcctgtattcgtcttattttccttatcttccccgctctttgccgattctgatacagatgaggaactgccgcaggcagtcagcatcccagccatgataaaagccatcataccggccaacattctttttttcatataaatcctcccttagttatatcggtagtgtcaagtctgacactccgttttttattaaaaaccttgtattttcagggattacaccacttttgaaaataaaaaagcaatgacctccccttttctggtataatgagttcaccacaaaccatcacctaaaaaggataaatcattgcttatggataacattatactctatttactcactataattcaagaacaatacaaaactatctgctggctcctgaactttatctgcaaatatattccactcaagcagtgggcctttgatggttcccactcccctaaataccagaagtttactaccgaccccctcccgctcctcaagccgttcatcaaacaggactggcagtttctccttgaatactatctctggaagtacggcaaatccgtcagacccgttcagcgccgcaatggtaaatccatccctgaagataccttctgtcctctttgtggggcacctcaccactatctctacgataataatggcggcaatgggcagttccaatgcaaagtctgtgggcagacctttgtcaccggcgaggttgtcacatcgcctctccgctttgtatgcccttactgcggccactccctcgtccctaataaggaccggaagtttttccgcatccataaatgcgtcaaccccaggtgctccttctaccttcacaacctctccagggttgataaggaccatctgcatgaggattacggtaaaaacaagtataagctgcactacctctaccgggaattcacggtggatttcttccgcatggacttagactccctgcctgagaattcctcctccctgaagttttccaaacataacgctcatatcatgtccctgtgcctcaccatgcatgtgaacctccagctttccctccgtaaaacggctcaggctctgtatgacctttacggaatcaggatctcacatcagcaggtcgccaactatgccagaacggccgccattgtcattaaaccctttgttgaccactatgaatatccaaagtcctccgtctttacggcagatgagacttatatcaaagtccggggcatcaaaggctacatctggttcatcatggatgccgcttcccgctccatcctcggctaccaggtttcagacaaccgctctgtcgggccatgcatcctcgccatgcgcatggctttccggggcataaaaagactccccgagaagtttcggttcattgccgacggctatagtgcttatcctctggccgcccagcagttcgtaagggagttgggagacagcttccagtttgacattacccaggtaatcggactcacaaacaatgatgcggtctctaaggagttccgcccctacaagcagatgatcgaacggcttaaccgcacgtttaaatccacttaccgggtcagctgcggttacgacaattacaatggcgccaactataacgtggcgctctgggtcgcctactacaactttctccgtccccataagcacaaccactatcgggtgctcaatccagtcggtatgctggagggggctgacaacatgcccgggaagtggcagctcctgattctgctcggtcagcagaccatcctccagctgaaggaacagcaggctgccggttaaatctgttcttagattccgggccagaggtaaaaatgcagccatcccgaagggacctgcccttgatggcacgccaaaacaatgctatcatgctgtgacgcagacggtgaaatcttatctgttcctgagttcttcgccgtcggtaagacgttcagagcattgttttggtgtgccgtcaagggtggcggacactgccagtttctaaatatatctgtaatttacaaggttcatttacgccgggttccccggccatcggttttcataaatcacttgacactaccgttatatcaggttttattctcctatttttatcaataccttaaccacatcttcttttttccggctgagaatatccagtccttcctgcgtcttctcaataccatccatctcctgggtcacataatccgtcagatccagatccgtattaatcatttccatggcttcagcgaaatctccggactcatagcacattgctccgtaaatctttaattcactaaatacgaccgaataacaataaaatggtatcttattggttatcatggctacaatgcctatttctccgcatttatgtacacattcacaggcctgatccagaatattatccgcgcctgcggcaataattgcgaggtcggctcctctgccccccgtcatctcctttactttttcgggaatattttccgtaacgggatccaatgctgcatcggcaccatgctttacggcaaattctcggttaaacgctgccgtatccgtaacgatgatgggactatagccccgtttcctggctaccgccagaatcagctggccgatcgtcccggctccaagtatgaccagtccgccggttctggtctctgcatggttaactgtatggactgcaaccgcaagcggttctgcgagagttcccatctcataacttgtctgatcggccagtttataaactgtcttttcatctgcattgaaatactcggaaaaagcaccaatccattcaggagttccaggaacctttttccctgagcacaggcttacaaggcctcttttacacatctcacattcaccgcagcctacctgcggctccactgtcaccctgtcaccaactttgatattcgtaaccttactgcctatttccaccacatcccctgcgatttcatgccccaggatagcaggcgcatgacgaaatggatgagttcccctgaacaaatgaagatcggaaccgcatacccccacagtttttgtcttaattaacacctccgtatctgagatggccggcttgtctatctcttttatctctaccttttcaattccagttacaaatgctgctttcaaaataatccctcctatagtttaatcgttattttttccggcaacgcgcgctttgctcttttatgatactaattattacattcaatcctgcaaaataaaaggatatttttgatttattttgtattattttgatacaatactgtatttttatcatttctactcgttaatatcttgacaattctcccgtttcattttatacttgtatcataatgatacaatttcattttagagaggagggattccatcatgacagattctaacaatcgtgtaaaaattctggttattgccccttatattggcctggttaaactctttgaggaagcggcgcagaaatttgataacatcgaactgactgcttatgaaagtgatacaacaaaggctgtctcttttataaagacgctttccatgaatgactatgatatcataatctcacgcggatatacctgcaagatgatccgggaggcatgcgggagacatgtgttagatgtcggcatatccatatatgatgttctgagaacaatccgtctggcgcagaattataatggacggtttgccgttgtgggatttcacagcatcatttactatgccatcatactaaaggatattcttcgctatgaatttgatattttcaccctcaaatcaacggatgaaatagaaagtgagctgaacggtctgaaggatgccggttataatatgattgtgggggatgttgtcaccacacagacagccaaaagcatcggtcttcaaaccatgctaatcaccaccagccctgaaagtgtggatgcagttcttaacaacagcctgtctctttatgaagaacagcttctcctgaaaagggaccgtgatttttacaaagatctgatctgcggcatggatgagggcacggcggtctacgatcaggatgagaacctgctttacgcaagccggctggaaaataccaaatttaaaaacgtcctgaaaaaatcggttgcctcattgtatgaaaaaaaggaacttcacttagttaaaaccattgaaaacaaccgtttcctgattcatggaaaggtaaggcggctttccgggcagctgtttgctgtattttattttaaaatcatcgataacggaaaaaaagacagcggactgctccgctactacaacaatacggatactccttttgcaagccaaagaaccttttacacccttagtccttccctcaaggtatccttagatgagattaaatcgtttcagttttttcagagaccggtatttatcaccggcccccgggggagcggcaaggattctttcgcgctcttcctgcatcagaaggatacaaggaaaaacaggcccatggtaatcattgactgcaggtttgccgaaggaagagaatgggaatatctgatcaaccacgaggattcccctttattttcggccggatatacgatttttatcaaggatatccatcaccttaataaagagcagctggaacagctgttcctcttaatctgcaatacagcgctgaataaaagaaatcaactggtattttcttatgttcccggaatttcctcgtcctttgaaaaaagtgatcttaaaaatgagatcatctatatccttcatgccctggttattaccatcccatctctcaataaccgcagagaggatattccaaatctggcctcgctttacttaaacgaatttaattctcagatggtgaaacaggctattgcctttgaaccggaggcattgaaggtactgcaggattttaactggaccgataatctctatcagatgaagactgttatacaggaattaattatgtatgcaaaatcctctcttattacggcagaggaagccgcctatgtccttaaaaaatatgagaccgatgataatcccagccacacctccggcgggatctcactggagggaacactggatgatatcacaaaacgtattgtcaaccaggtgctccgtgaagaaaacatgaatcaatccaaagctgcaaagcggttaaatatcggacgaagtacactgagaagacatttgtaagcgcgttttcctctttctcagcaattccggccatgaagttaatattgagaatcccgataagctttccacaataatttatgatttttggttaaatccatactgaatgttggggtgtgcaaaaaagcacacttccagcatttttttgttgatggcggtgacctgtacgcggtgcatccaggttatcgttcggaataaagaacttctataaaccagtgttaacggatagttaaggttacataagaaattgcttaaaatgtaggaactttaattattcccataagaaaaaatataaaacagtcagaaaaaacagttatattaaaattaatattgttaataatgcacaaaaattgttaaatatcaaatttgacagactcataaaggagctttataatcatgattataaatcaaacactgtttaaaaaatggctgattctgaatgcaatgagtaaccgtttttccaggtcaggatgaacgcagcagttacccaaaggaatttagccgggcagaaaggagaaggtttttatggatgagaaaaatgaaaaagagaaaatgaatgaagaaaaggaagagctattgaaggagcgggtatttttctattttgcccagctctgccggatcccgcgtcaaagcggcaatgaaaaagcggtcagcgactttatcttaaattgggcgcttgatcaggggcttaaggcaaagcaggacgcggtcaacaatgtctttatccgtaaagcggcatccgccgggtacgaagccgcgtctccagtcatgcttcaggcgcatatagacatggtctgtgaaaagaatgagggggtaaatcacgattttacaaaggatccaatcaaatggatgattgaaggagacctgatatcgacaggaggagagacaacacttggagccgacaatgggattggggttgcctgtgcaatggcggtgctggaggataaaaccctggctcatccacggcttgaggttttgtttacggtggcggaggaatctgattttacaggggcggccaattttgatacctcctggatggaatcagaccgcatgatcaatctggatcacgcttccgacaaggaaatcctgtgcgggagctgtggagggatggatgccgttatcactcttccaatcaagccggagaaactgaaaacaggatggaagacctgtactgtcaggatatacgggctgaaaggaggccattccggggaggatatccacagaggacggggcaatgccaatctcctgctcggaaggtttctcgctgcggcagaaaaacggtttgcatacgggatttcagccgccggaggaggaacctgccgtctggctataccgcgggaagcaaaggccgatatcagcctgggggaggccgatattaaggaactgcaaaagctggcggaggaactgcaggagatgtttcggaacgaacttcaggcaacctcatcctctctctgcatctcagttacagaagccccggcagcaaaatttcaggttgctccagagaaaattattaatttgattctgctggcgccggatgggatctgccagatgaatgaaatgcttaccggattggttgacacatcggataatatgggcgaattacatatggacagcgagtcgtttcagcttgtgtttgaaatacgctcggctaaagacagcctgaaatattttgtttatgacaaaatatcgcgtttgtcaaaacttctgggggcggactgtaccacgaccctggaatacggaagctggcagttcaggccccagtcaaaattccgtgacaaagccattgaggtattcaaaaagacttatggaacagagcctgccgtcctgacgcttcatgcgggactcgaggtgagatacttctttgatgcaagaccatctctggacgctatcgcgctggggccggactgctggaatttccattccccgtcggagtgcgtggggatctcttctgtcagaaggttttataagtatttatgcacacttttagccgagttgtattgagagccatatacatgggaaaggaaagcaaaatggataaagatatgaatgatttaaaagataaggaagccggtgagaaggacagagacccgggaggcttaaataaaaagccaaaattaaaggccctgaacccaatgatattccttgtagtgattatccttctgtgtgcaattgcttcctatgttgtcccggccggttcttttgcccgtgtgacgaacgcggccaccggaggggaggttgtggatccgggcagttttcaatatatggccaggactcctgtcagcgtattcgctgtgctgatgtcggtgacacagggaatgcagaatgccgcctatattattttcttcctgctgattatcggaggcacttttgcaattatggacgcaaccggtgcaattaatgccgggatggccaatgtaatcaggaaaacaaggggcagggaacttctgatgattccaatctgcatgattatattcggatgcggctccgccttctgtggcaactttgaggaatttctggcatttgtgcctttagtgctggcatgctgttttacgatgggctttgattcccttaccgccgtcggcatcattttctgcgctgcgtcggccggatacgggggagccatgacaaatgcatttacggtcggcgtggcccagagtatagctggtcttccgcttttttcagggatagcgctaaggagcgtcctgtttgtctgtctgttgaccgtcagtattctctatgtcatgtggcatgcctacagggtaaaaaagaatccgcagtccagctccgtgtatgagtatgatatgctccatgcccatgaacatttaattgatattgattatatgcctaaggttacgacacggtgcaaactggtactcattgttttcgtaggcggtattgcctatacggtatacgggattattgtcaagaaatattatattgacgagctgtcggctatttttctcgcgataggaatactgggcggcttggtcggcggcctgaagccaagcaaaatctgtgatgaatttttaaagggctgcaccaacatgctgttcccctgtgtcatgatcggactggcaaacgccgccatagtaatactgaaaagtgcaaatattatggataccattatatatgccctctcaggtctgctgaataatcttccgccttcgattatggcctgcggcatgtttatcctgcaggatgtattaaatgttctcgtcccttccggctcaggacaggccgcagttaccatgcccctgatggcgcctctttcggatatgctgggtgtcacccgccagactgcggtgctggcgttccagatgggctccacttttaccgatgtgctggcgcccaccagcggcgaaatcctggcggcgcttgccatgtgcaaaacgccttacggaaaatggatccggtatttactgccgctgttctgcatgtggtgcctgattgccttcgcgttccttatctatgcggtgaagaccgcatacggaccattttgacggtccggcttgtcatcacagcaagtgcgcagatctgtccagcgtgtttcagatctgcgcactcggaaccagatgttcctgtccgttgcgctatatcccaagcaacttctccctgaaaagagaacaaaaaagaaagacctctctcaaagtctttcttctttttccctcgctcattttatacaagttttcactcagtcttttttcggtctgtcttatctcggattttcggtctgtcttatcgcgctgagccaggtgcttctgctttcaaagtcttaagttcatcaaatacgacatcgttcaatactttgatatacgttcccttcataccggaagaacgtgattcaatgactcccgcgctctcgaatttacgcagggcattgacaatgacagaacgggtgatgcctactctgtctgcaatcttgctggcaaccaggataccctcattgccttccagttcgtcgaaaatatgtgtgattgcttccagttctgaaaatgataatgtgctgatagcggacttcacaatctgaatctttctggtctcttctgcattctcctcatttacggaacgcatcatctcaagtccaactaccgcggtgccgtattcgcttaaaataatgtcatcaatgtcataatgcgcatctgctttgtagatgaaaagcgttccaagacgctctccggaaatgtcgattggagtaatgatagcctgatacttcctgacattctcctctgcaaatcccagtgtcgcaagattgacattctctttggtggataaaacactgagaaggcgctcattcagcataccgtcgatatagccgcccacctgatctgcgatcagctcttctatctcatcaattccaggacaaattgcaacccccagtactttccccttcttgctgattacaaggatgtttgactcgagaatttcgccaagcacttcacagatgtcattaaagacaactttgtgagaatggttgttatgcaataatttgtttatttttcttgttttgtccaacaactgaacactcattaccagttacctccttcgcttaatctttgtatcgttagaaattattgctatcatgtacaaattttaacacgatttcagattaataacaagagtttttctggttttttcaatttttttaataattagggtcgctcatgaagcgttttgacaaatccacaggcctcatttgtacacaaaagcttgcttcctttttccaccatcatgctgccgcactccggacactgctctgtggacggtttttgccaggacatgaaatcacaatccggattatcctcgcatccgtagtatttacggccttttttcgtcttacggatgacaatctccttgccgcacttcgggcatttaacgccgattttttccagatatggtttggtgtttttacagtcaggaaaaccgggacaagccaggaattttccgtggggaccatatttgataacaaggtttctgccgcaaagttcacagatttcttccgtaacttcatccgcaattttgacagtatcaagttttgcatccgcttccttcacagcttccgcaagatccgggtaaaagttctcaacaacggtcttccacggtacatttccgtctccgatgctgtccagaagatattccatgttagcggtaaacgcagtgtctacaatcgtcgggaaggccttcatcatcattccgttgacgacctctccaagctccgtgacatacaggttcttgttttcctttgcaacatagcgcctcgcaataatagtcgttatggtcggggcgtaagtactcggccgtcctatcccctgctcttccagggcctttacaagagatgcctccgtgtaatgggccggcggctgcgtaaaatgctggctgctgtcgagttcgatgagattcagtgccatccccttctccagcttttccgtcagaacgttattctcctctttctcatcctcctgaacataaactgacataaaaccgtcgaatttcaccttggaagcggccagcgtaaagatatgctctcccgccgtcacttttacggatgtagtctcatataccgccggctgcatccggctggcagtaaagcgtttccaaatcagttgatatagacggaataaatcccttgagagagattccttgacgagaacaggtgtcagggcgatgtcggtcggcctgatcgcctcatgcgcgtcctgaatcttgacatccgacttcttggccgccgcctctgccgccacatactggccgccgtactgggctttaataaattctctggccgccgtatcggcctctgccgccacacgggtggaatcggtacgcagataagtgataagacctactgtgccgtgtccctttatatccacgccctcataaagctgctgggccagacgcatcgttttctgtgtggaaaaattcagggctttggatgcctcctgctgcatggtacttgtcgtaaatggaatcggcgccttcttggtgcgctctcccagcttcacctcgcttacctcatacggctggttctccagcccgctcagtatctgatccagttcctctttgttatgaatcgccttttttccgtctgcatcgccgtagtatttggccgtgagcttcttcttagagccggggaccttaagttctgcctccagattccagtattcctccgggataaaggagttaatctcatcctccctgtcacagatcattctgagagctacggactggacgcgtcccgcactcagccctctcttaaccttagcccagagaatggggctgatcatatagcccaccatacggtccagaacccttcgcgtctgctgggcgtccaccagattcatatcaatctctctcggttcctttaaggatgccttaaccgcgttctttgttatctcattaaaactgatacggtataccttcttatcctttaattcatcgagcttcaacgcttttaccaggtgccaggaaatcgcttcgccttcgcggtccgggtcagttgccagataaattttatctgccttttttacctctttgcgaagcttcgcaagtatatcccccttacctctgatggtgatatacttcggctcataatcattctccaaatctattcccagtgtactcttaggcaaatctcttacatgtccgccagacgcgtccacctcataattcgttcccagaaattttttaattgttttcacctttgccggcgactctacaattaccaaactttttgacataacaaactcctactccaatttccttatataatattgattgacaggctgcataatgaatccgtccatttcaagtcttaaaagtgctgccatacattcccctgacggcagtttacttatttttatcagttcttctacatgtttcggttgtgaatctaagcaactatacaacattttttccgtcttggcaagcgtctttaccgattttttcatgacttttaggcaatttttacaatctattctgaaaaaatcaaggatatcttccggtgtttgtaagagtgcggctccctgcttaatcagtccgttgcatccctcgcttaacgggtcgttaacacgtccgggaacggcaaagacctctttcccctgctccagagccatatccgccgttatcagggaaccgctgcgtttcctcgcttctattacaattaccgcatcggaaagcccgctgataatccggtttctcaaaggaaaattgcgggccgccggcttctcccccggcccatattccgaaataacgcctcccgtttccagaatcgcgttataaaggctcagattctctctcgggtaacaattatcaactccgcttcccaaaacagcatatgaggccccctgtgcctttacagcccccctgtggccggctccgtcaataccgctggcaagtccgctcacagtctgtatcccgttttccgccagaatcctcccgatatattccgccacctggcgtccgtagggcgtgcagcttctggcgccaataaccgccgcagtcggcaggtgttctttcggcagatcgccttttacaaaaagccacatcggcatatcatagatattctcaagacgccgcggatattccggctctccggccatgataaaacggatgccgttttttctcaattccctgtactcacggcagcgcttcccaaagagggcttttgcctcctgaatatgctctgcgtcctgtcctctcaggaagggaagtgtttccagaacctgtttcttcatattatatatttcctcaaagcttccggcatattctaaaagttttccggacttcaccgctccgattccgtctaccctgcaaagccagtagaggtattccttttctctttcgtccggcaccgatgtcccccgtttttttaatactgcttctcttttagcttccgctctcatttctgatgttctctccatatattccctctccgcgctattgttaattcacggacacgtcccttcaaaacttgaagccccagtatttcttttcaaagcttctgaatgagacggcctcccccaggtgtcccctgccgatttgtttcttctcgtccaaatccgccagggttctggctgttttcagtatcttttcacatcctctggcgctcagtccgtatgccctgaaaacatcgttcagaaaacgttcatccgactttttcaggccgcagcagttctcaatctggcgtttccccatctggctgttaaacctgcattcctcccctttgaatctctcctgctgaatctgccttgccgccatgacccgctccctcatggaagcggatgactctcccctcttttttcctgttacaaacggctgagcctgccttggtacctcaacgccaatgtcaatcctatctaaaaacgggcctgaaatacggctcagataccgcctgatttgtgtctccgtacaggtacagcggcccagatccggataaaagccgcatttacatggattcatagcggccgccaccatcgcatccgccgggaactccaccgccccgttcagccttgttacggtaatcatccgttcctccatcggctgcctcagaaggtccagaagggcggccggaaactcaggcagctcgtcgagaaacagaatgccgtgtgtagacagggatatctcccccggcctggggttcctccctcccccggcaagcgcctgggcagtgataccgtggtgcgggctcctgaacggcctggcccggataagcggctcttctttttttaacagcccgcagatactgtagattttagatacctcgatgctttcttccagcgtgatagggggcattatagtcggcagcctcctggccgccattgttttgcctgtcccggcaggtccgataaacaggatgttgtgccgtccggctgccgcagcctggcaggcgcgccggaccgtaggcagtcccagcatctcatcatagtctaccggataagaaagtctgtcctcttcccggaacatcgcctcatcaaaccaatggcctgcggcttctatacgcccgctcaggatgccggccagctcgctgaggctgttaacgcctattatttcaatatcttttacggccgttccctccgccgtgttttctgaagggacaaacatacgccgtatcccctgtcctgcggctgcgaatacacggggaagcacgcctttgaccggctttacgcagccgtccagacccagttccccgataaaagccgacttctcaagcccggcctctgacgcctccccaagacagcagagcactgccgctgcaattgccaaatcataggctgtcccttccttccttatatccccgggcgacagatttaccatcacctttttcggcggcagatgaatccccgcatttttaagagccgtcctgacgcgttcctgtgcttccctgaccgcttcggaaagaaaccccaccataataaagccgggcagtccgtcgctgacatcggcctccaccgtaaccggaaacccttccacaccgtgaaccccgaaactgttaattttactgaacaaaaataaggcctcctttatcataatttaaatgctgtgtgttggaataatgctgtgatgttcttgaaacttctgaaaatagaatattgatttgagattgacaagtctagcgttaactttgacgtttaacctatgatagctattttatcatatcaaggccgggcttgcaagaaaggaaatcagagaccgtaaccggagcagctttaacgctgctgttcactgatagcgtcatttagtcagcactgccatgaaatggagctttaactgaggtttggaggacgcgtccggaaggggccatgtccggtgtggcttgtgagggacctcgctaagcaccggcggactcccatgtcccctccgcaattgattccgcctgcttccccggtccaggttttcaccggagacggaagactcaggcggaggttttctcggcaccggatatggtcccttccgggcgctgactgtctctaactttaaatagggagagccctgtcgcggccactacgtgtttttcgcagactttatcttcgcccgcagccccaaaccacggcaatcttcccccaggacgaaagactcaatatcccggtatacctcgtcccggttcagttcattgagaagttcatgcctcgcccggggatataattttatcctgacatcgctcatccccagactgcagaactctctgtagacttttttgacgcctcttcccttatcaccgaccggatcctgcgctcccgacagcaggaggaccggcagcgtctttggtatctgttcaaactgctttttctgcacaagttcagtcatcacctgaaagaaatcctcataagctccattggaaaagataaaacggcaatccggatccgcctcgtattttctgttttccgcaatgtccctggacagccagtcatgctccgtttccccaggctcaaatggtttgttgtaacttcccagaacaagtctgtgcagcgtttcattatgataatcgcgcccttccttctttattgcccggcggaccaccattgtcccgagcttcaggacgacggccggcttgctgcctgttcccatgattatcgcaccgtccacctgctccccgcagatagtcaaaaaacgccttacaaaaaaggatcccatactgtgaccgagtatgaaatgaggaaccgaaggatactggcgctctgtaaaatctgatatgcgcctgatgtcttccagcacataaaaggccccgtcccggtcggaaaatgttcccaggcagccgggacgcgctgtttttccatgtcccagatgatcgtgtccaatcacggcaattccttttgcattcatcgcttctgcaaaagcgccgtaccgcccggcatgctccagcatgccatgtgatatctgtattacagcggccgcgtccgaatcaggaagccagtggatcccatggattctggaaagaccgtcgctggaaggaatataaaaatcaaatctgctgcccatactgttttctcctgtccttatatcagattcatctgtttccactttcccttacggtatcgcaggatgaagagcgtcaggcggaatatccagtccatgatcatcgctatccagactccgattacgcccatctgaaaatggatccccagaatgacactgaacagaatcctgaataccaccattgaaaagaccgaagtcaccatcggcattctgacgtcattcgccgcccgcagtgcattggggagagtgaaggccaccggccacataacgatagcgcctgcacagtggatccatacgagaattttcgtaagctccgccgtctccggggtgagggaataaatgttcagggccagcggcatgctcagaagaaccaggccgtttacaacggcaccggctatatatgcggttttcatcagtttcttcacataatattctacctgctcatagtctttagcgccgacacagcggccgaccaccgtcaccatcgccagattcagcgccatgccggatatcagtcccatattgtccaggttattcgccacggcattcgcagctatctgaaccgtcccgaatccggcgataatgctgacaatcagtacgcgtcccagttggaacagtccgttttcgattccgtttggaattcctatgtacagaatctttctgatgacagagccattcagacggcacagggagcgcagattaatgtaaattacgttccacctgtccctcaaaagccaaaccataatcaaagcggccactccccgtgaaaaggcggttgcccatgcggcgcctgcgacccccattgaaaagccgaaaatcaggacggcattacccgccacattgatcaggttcatcaggacagatactttcattgatattttagagtttcccatggaacggaacaatgctgcgcaggaattaaaaaccgccagaaacggataggaataggccgatattctcagatatgtaaccgcattatccatgacctcccgggccaccgacggatacagcagtccgagaaaatgacgttttgtcagcaggacggccgccataattatgagagaaatcagagtcgtgacaatgaggagctggccagccgactccctgcacatatccttattccccttccccagatattgggaggacacgactgcccctcccgtggcaagagcggcaaacacattcatcagcagaaggttgatgagatctaccagtgcgacacccgaaatggcggcctcccctgcatagcttatcatcatcgtgtcggccattcccactgttatggcaagtatctgttcaattatcagcggtactatcagcagtctcaattccttgtcggaaaataaacggttcattctggttcctccggtcaattttacaatatccttattataccaaaaatccggcgagatgtcctgaaaatttatgttattgttcacagcacgccgctttttggcggggtgtgaacaataacaaatttattcctccgccgataagaaaaaagcggacagcttaacgctgcccgctttcatcatttaataattagtcgtttccgtacagagtaaccagcttagtaagatagttatatcttgcttttgcatcttcctcattcttagcgaacaatgcttttgctctctccggattcttaagcgcaagggatgtgtagcggacctcgccgtttaagaatgcctggaagtctcctgtcggagccttgctgtcaaggctgaacttcttctcagcagacggattgaagcggaagttgtgccagtaaccgcactctacagccagcttctcttctgtctgagccttgtccatacctttcttgataccgtggttgatacatggtgcataagcgataaccagagacggacccggataagcctctgcctctgccagtgcctttacagtctgtgcatagtcagcgcccatggaaatctgtgccacgtatacataaccatagctcatggcgatggaagcaagatctttcttcttcacatcttttccgcctgcagcgaactgtgcaacagcgcctgtaggtgtagccttggaggactgtccgcctgtgttggagtaaacctccgtatcgtataccataatgttgatgtctttgccggaagcaagcacatggtcaacaccgccgaagccgatatcgtaagcccatccgtcgccgccgaatacccactgggatttcttagcgaggaagtctttattcttaacgatgtctctgcatacagggcagtcaattccgtccaatgcggcaacgagcttgtctgtagcagttccgtttaatgctccgattccgaatgtgtcaagccattctttgcatgctgcttttacttcctcggaagcttctgctgatgcaaggatgtcttccactttcttctttaagccgtcgcggatagcgttctgagccaaaagcataccgtaaccgaactctgcgttatcctcgaataaggagttatcccaagccggacccttgccttctttgttcactgtgtatggtgtggacggtgaagagttaccccaaatggaggagcatcctgtcgcattggagatatacattctgtcaccgaataactgtgtgattaattttgcataaggtgtctcgccgcagcctgcgcatgcgccggagaactcaagtaacggctgtttgaactggcttccctttacagttgtctctttgaatttctcaattacatcctgtttaatcggaagtgactggccgtaatcgaagatcttctgctctccgaggctcttctcaaggctgttcataacgagggctttctcacccttcttgcccgggcagacatttgcacaggaaccgcagcctgtacagtcaagagcagatatcgtcatggcaaatttgtactgtggcattcctgtcataggaagtgtcttcattccctctgcccctgcggcctcctcctctgtaagagctacaggacggattactgcgtgcggacatacataggaacagaagttacactggatacagttatccggattccataccggaacattaactgcgataccgcgcttctcatatgcggaggaaccggatggtgtcgtaccgtcaacgtaatcaacgaaagcggataccggcaggttgttgccttcctgagcgttaacagcagcctgaaccgtattaacgaacttgacaacgtcttctcttccctctgtagcgtgagtcatctcaagaccttcgtcctctgccgtcttccagctctccggaacctgaatctctacgacattctgagcgcctgcatcgatagctgcccagttcttcttaacgacatcctcacccttacggccgtaagttgcctcagcggctgccttcatcagttcgattgctctctcctccggaataatagatgccagtttgaagaatgcggactgaaggattgtattgatacgtgtcgggcccatgccggtctcaataccaagcttcacaccatcgatggtgtagaatttgatgttgtgatctgcgatgaacttcttaacctgtcccggtaaatgtttttcaagagcttccatatcccatgggcagtttaacaggaatgttccgccgtccactaattcctgaaccatattgtacttacggatataagcaggattatggcaggctacaaagttagccttgcggattaaataggtggatttaatcggagtatgtccaaaacggaggtgggacatcgtaacgccgccggattttttggaatcatagtcaaagtatgcctgtgcatacatatccgtgttgtcaccgataatcttgatggagttcttgtttgcgcctaccgtaccgtcggctccaagaccccagaatttacagttaacggttccttccggtgtcgttacaagcggagcgcccagttccagggacagatttgtaacgtcatccacgataccgattgtgaatactttcttctctgtgttgtcataaacggctacgatctgtgccggagttgtatctttggaacctaagccgtaacgtcctgtgaagataggtgtctggtcaaacttcgttccctttaacgctgcgacaacatccaggtataacggctcgcctaaagagccaggctcttttgttctgtctaatacggaaatctgttttacggaatccggaattgcttccactaatgcgctggcgcagaatggtctgtaaagacgtacctttacaacgccgacttttctgccctgggctaccaggtagtcgattgtctcttcgatagtatcgttgacagaacccatggaaatgattacatgctctgcatccggtgcgccgtagtagttgaacagcttgtaatccgtaccgatcttttcgttaaccttgtccatgtattcctggacaatcgccggtaatgcatcgtagtatgggttgcatgcctctcttacctggaagaagatgtcagggttctgagcggaacctctctggcacggatggttcgggttgagcgcgttcttgcggaatgcgtcaacggcgtccatatccaccatatctttcaggtcttcataatcccatgcctcaaccttctggatctcgtgagatgtacggaaaccgtcgaagaagttgataaatggaatctttcctttaattgcagcaaggtgggcaaccgctgtcaggtccataacttcctgtacgctggattcacagagcatggcacagcctgtctgacgacatgcataaacgtctgagtggtcaccaaaaatagataatgcatggcttgcaagtgcacgtgcagatacgttgaatacgcctggtaactgctcgcctgcaattttgtaaaggttcgggatcatcagcaacagaccctgggatgcagtataagtggttgttaaagctccggctgcaagggatccgtgaacggctcctgctgcaccagcctcagactgcatctctgtaatctgcactgtctggccgaaaatgttcgttcttccatcggttgcccactcgtctgtagcttccgccataggtgaagatggggtgataggatagatggccgctacgtcagtaaatgcataggaagcatgagctgctgcgtggttaccatccatagttttcatttttcttgccataatgaatgttcctcctgttattttaaagtgaatgtatagttgaatcccctctcggaaatttacctgagaatattataacaactttttgttaaaatgcaaacgaatttgaattgttctggcgtattattttaaaaacaataaaatttcttattattagcaccgcctttttctatcagggcccggatcaatttttcattccctgtgccgcgttctctacggttatggtcccattttccaccagcttgacaaacagctctgcaagcgtgggatcaaactgccggccggcctgtttgcgaagctcctggcaggcgtattcgaccggataagacggtttatagcttcttaccgaggtaatcgcgtcaaaggcatccgcgacggccaggcatctggctccaatcggaagctcctcgcccgtaattccccttgggtagccccgtccgtcccagcgctcatggtggcctacaacggcaggtatcaggtagtccaggctgggcaggtgccggatgattgcaatcgaatgctccacatgggttttcataataccatattcttcgtcgcttaactgtcccggctttgtgataatattctccggaattgcgatttttccgatatcgtgcagaagtcccgcttcataaatcatctgtgcatgctcttcattcagtccggccgcctttgccagggtttttgcataattcgccacattctggctgtgactgaaggtatagtgatccttcgcgtcaatcgcggcggtcagagcataaatcgttgccgcatattcctcatagtttccggtcattatattgctgcgggccgtctcaatatccgaatcggcctctgcaagcgaatactggcagattctgtttttcccgctccgtttggcgttgtaaacagccatgtccgtattctccagcagttccttcacagaagacgcgctgtacggagccacgcagattccgccgctcagtgtcagggcttttaagagtacgccgcttccgtcggtctcctgccggcctacctgctgcttgatgtttttagccagctccagcgcctgatacaggttgtatccgggcatgcagatcgcaaactcttttccaccgtagcggcacgatattccgtttcttcccacggtgctgagtatgatctgcgccgtacgccttaacgcattatctccggcataggtgccgtaaagctggttaaacagtttgaagtcatccaaatccaatataataagcgctacggaatcgttccgtttatcattgtatacttcgttcagtctttccataaatgattttcggtttaaaagccccgtcagatggtctaccgtagcctcgcgctttgcctgttcatataaattggcatttttcacagctatcgcggctatcgactgtgcggactccaggaatgatatatcgtcaaaggtatattcgctccccttcatcttcctgccaatcagcacaacgcccaccagatcgccgtcgcgtttgagcggtacgatacagcttacctccagcccggacagcagccttttctccgcgtcccacatggatttgtaggtggaggaacgtttgaaatccgacataaacatacaattttcccgggtattaaaccaggtgatgcagggattgtcggaggagatggaaaatgccttctcatccaggggcgcagccgagcataccggcctgaaatgctttcccgtctgatccttcaggcagacataagccttattcacccggatagaatcgcagattacccgcaccagcagagctaaaatctcctgtaaatccaggctttgggataccgccgtgctgaattccttcagacgttcctgctgtatctgttcttccctcaaaaacaggttgtttaatattttttgcaggagctggtaaatcagcatcatggatacggcgaacaggattgctataattaatgtcgtgtaaccttcaaattccggaaaataagtctgcagcttctgctccgtcggccggatcaggtaggcacccataaccgaacaaaggcacatggtttccgccagcaccacgcctcttgacaccagaagcgtcatacggaacagcctcttacggtacatcgcataaaacatcaggcttgcgtaaataatgcccgacagcgtgtcccacggaaaatagttgcccggcaatattgaaatcagattgccgataatcagaaccggcggtccaatcatgatcggcagaaggctgcgcaccggcacgtcacgctcttttacgccataggccaccatcctggccccatggatcagcatcagtactattaaaaaggtcggaatcagaattttccagttgctctcataaagaaatacaaacctcccgtcccctgtttccaccagctccggagcctttaaaaacaattcaaaatgggtcaggatcagaatcactgccgtaaccagcagccatacctttttcatgtacttgtctctcgactccacaaaatggtacaggaacatatataccagataaggcgccgcaaagagagccagtatggacagctcataccacagcttataaccgggatacagcctgagcctcataagaagagaacagcccgtccatatggtaaaacagaaaagcagctggataaaagaattaataagtgggtttttcttggccgacaacagcgcaatcatcaaaaatgcatagcaaaaaactgccagtatcggcacccaggtaaaaggaatcactccgctcatcttccatacctcctgtcgccgtttatctgatacgtatcaaactttaaaaattctgaaagttcaaatgaagacggatttaccctgcgtagctttttccccgtaagttcctggtactgttccatcgtaccgcatttcagaacagttatctgcagcggttctatgcccagcatttttttcaaatcacggtaatccgtatcaaaaaatgtaaaatatacttccagatgctctttcaggatctgggtgctgacagccatccttcccaggtcggccggatttagctccacatagatatggaggtaaggacgtctttttgtgtcatattctttttttgcaatccagtgtttgattgacaggccggacagacgaatcacatcctcgatggaattttccgtaatccgggtaaagcctgcaatatcgatcacccacggcacccgatccaggaataccagttggggcagattcgtgcttttatctccaccggtgctgacacagcggaacatatccccgatcctgtagcgcgcaaatgctccgcctttcaacaccgtcacaaccagctcataattctgattggcgaccagttcatccatcaggatggtaagcggctggtaggacggatcatccatggatttatacacttcatcttccgggataaattcataaaagcaggagtctggaaaaaataccatcccgttgcgggagtgggtttccgtgcctacaatcgaaacctcggtaccggcaaatatctccagcggatcgattccccacgcctccctcagcgcatctttgtaggaagccgtatctgttcccgcacataccagtgatttcaggctgaaaagatccctgggttcgatatcgcgcccttccttggcacactggtatttggctttgagaaaacggtacagcatcaggggtttcattttaaccgcctttttaagcatccctcccgatgccccgccctggaacgacgaagcgaagttctccgtaatataaaacgccacgctgctcaggccgaagaacagatcaatccccttctgcatccccagggaaaacccctttttattcctctcgccgaaggacatactgtgggcttctttcaccggaggcaggaatttgaaatcgattttttcttcaaatactacgggaaagagccccgtaacaaacggaagcggggccaggccgaacagtaccttgtcaccattcttaagtcttgcctttttcgtctcattgctggaagataatgtagttatcgccatcagattgctgcggaaaacgtccagcatgcttctggtgtagggcgctactttgaccggatgtttgccgctctcccatgtagtctgaagccagataaccggttccccgggcagcatgtccgtcttctttgccaacaggatatccgcataatccccataagtggtaaggggaacggttctcctgaaatcctcgattgtctgcggctgtcttcctttaaggaacatctggcccagcccgctcgccgaccagacgctgatttgttcttccagcagccgcttctggatctccatatactcctcaatggataagtccagaaagctgcaatattcttcccatatttcgcggtactgctgtttttttaccttctgtccgtaattcaactttcgtctccccctttgcccgctgttttctccattctgccggtctttaaatcactgatgcattttctgatgctgtctgcatcaggtatcagatatggagtttctttcctgtagtcatcatatccctcaaacaaacgggggaatgtatatctgtcctgaagcaatatgtacagcaggttcatccctgtatataccgtgcccgccagcagcataaacggcttgccaagccccaaagacagaaacagataaaatccggccaggaacaacacccccgggtgtctgcacaatgcatatacccctgtcttacaaattttttgttttgagccctccacataagcttcctgaaaaggcacggcaaagaacagtgtgtaaaccaacagcataagctgtatccctgccagcaagaaaaaaacagcaacggcaggaaaggtgacctgataatcactctcgaattccgttactgacatagttattgtaagcacacaaagcgtaatgcagcccactgcgaacagcggcctgatacccctgtggtttttatggatttgatttaaatcatacagaataaaaaatagaaagcataagcatcccagtcctatgtaagtcattcaagcagtctccctttgtcccggttattatatcatccgcatcatcattgtaccaaatcgtttatataaactcaatataaaactgcttttctttagccgtcccacaaaacatcaaagggaaaaccttctgttacaaaggttttccctgcataaataattattgatgttaattgcttccgggccctgccggaacgtcgaccacgggattcgtcggaacaacggggctgcctccggcttcctgtcccggactgctgccgctgccatctcccggcgtcggtcctcccggtgatacggtgcccggagacggtgcctccgatgactcgccgccggggcctgccggtccctgggtatcactctggcctggaattgtctctccctcgcttaccggaactgtctcggcaatagaggcggacggatctacggtcgtgataaccacacccgatgtatttctcttaataatcgccgcttttcctctgtaactgctgttatggaagaattcacggctgatttccttgccatcctcatagattacgagataagtggtccatctgctgccgggtacggcctccttcacgaccttctcttccgtaagctgaagtgtctggtcttcctcatataccggaaccggcggatcgatggtgcttgtcttctcagaagccatgcggaccttctgaccgtcttttacgatctgcactccatagatggaaatggtcagctcctgattgacgaagttggtcttaatcgccaccggataattggaattattaacaaatttgaagtccggtccgccgaagctcacggccgcgtcttcacccggtgttacataggacggctcgtagctgtgcgcatggcgctccgtactcttaagtcctgcaaaaataacggcattatataaagtggaggaaacctggcatactccgccgcccggctcctgaaccacctctccgttcagatatgcagtggccggcttatagcctttggcctcggtacgcgctcccgtcgtttcgttaaatgagaactcctgtccgggattaatgattgtcccgttcagcgccacacaggccagcctgatattctcgttacggttgctgttggatgtcgtcttggtggtataggttgcaatcgtcttatacttctctttgagctgtgctgcagtaagctccggggaaacctctttcacgcttgcctcgattaccgcatcgtaatctttattgtgaacggcctccaccatatcggccgcaagcttgtcctggtcgatgacaagaccgtttgtgccctccgaaaacgtaaatttgcctgtttccttatcataaccggaaataccgccgttcttggccaccatgttccagttgccggctatcagggccgcctcagcctttgccgcctccatcaggttctgatccgtctcatatgctttggcttcctgcatatcgcccgcataaatttcttccaggatattattcaccttttcgacaagtatattgttaaccgaagcttccttatcctggtacttcaccttcatgttccagttgtactgctttaaaattgcctctctggcctcgtcctgagtcattccggtaatatcgactccgtcgacggttatctggttttcagccgcgctggaggattcactcacggacgatgactctgcgctctctcccgtcgtacttgccttacggcatcccctcaccgcaagtgcgatgcagagtattacaataattgcaccgattccatacatcagaatctgcgtgatatcataatcattcttctttcttctcttattatggcctttgcccctgttgttaagggaactgtgcccggccgatgctcccgatactctggctccctgacgggtattccttctgctgcctccgctgcccgctcttctcgaagagcttgtatttgatgtccttcttctggaagatccgttactataatcactcataatctttcacctgtctacataatcttgtttcgttcatgctacagtatagcacaaatctatgaaaagaaaataacttatttcttaaatttctttttacgttaaaataatacttttttcttgactttttttgccgggaaatgtactgttttaccaaaacggtgaaaggtgaattttcatccgcaccaataatcaggaggtattttatggaatttattgatcttcatgtgcattcctctgcttcggacggcacgctcgcccccggcccggtaactgaactggcgctggaaaagggactgtacgcctacgctctcaccgatcacgatacaacggacggcatcgacgaagccgtgagggctgccgccggaaccggactggaggtgattcccggcacagaactttcatgtatatatgagggaaaagaaatccatataatcggcctcttcattgaccatcattcccctgagctggtaagggcgctgacgcagcttcgaaaggatcgcgataaccgcaatatggaaatgctctcccttttccaaaaagacggcttcatgattacggaggacgccctggcaaaaggcggatcgctgtccgtcatcacaagggcgcattttgcccgggcgctgatggaggccggctatgtctccacgatggatcaggcatttaaaaaatatctggagcatggcaggaaatactgtccgccaaagaaaaccgtccctcccgccgaggcaatccggctgattcttgacgccggggcctttcccgcgctggcgcatccggtccaatacaagctgggctgggaaaaaaccggcaggatgattgcaggtcttaaagagatgggacttaagggaatcgaggtctattattcgtcacatacccaaaacgacagtatgcgtctcagggaaatgtgcctccgcttccgccttctccccaccggaggctccgattttcacggttccaacaagcctgatatatccattggtaccggaagaggcgggctgcgcatctcccggcttctgctggatgatataaaaaagacgcttgcaaaagacgccgggaattagatattccccgcgtcttttttcagtgcgcccggcggcgcacgtctctaaccggtgaaagtccggaatccgcccggtggtgggaaggatatagccgaaggcaagggtgttcatcgtgaggtgaaatctgaaggaagccggatgtggggaacatactaacccatgggcaaatctctggtctgacggacagaaatcacatcaggccatgcgtgagggtaaggctgctgaacaagtcgaagcccaataaccacacggaatcacgtatggtaaatgtggcagatagatggagagaaagagacgtgtggtacccggggaggtctgtgcggaatgtcctgaaagggataaccattatcgaaagatagtgctgaacgtacagaagtcagccgaggtcgtagtagtcgagagatgaaggaccgaatcaacaggagtctttagtacaactgggaaaggaggaaagaacattgggtacagaaaacaaagatagctgctcgcaaagagatagcgcggaacgtgaagggtatgtgagagcgcaccgttctttccgccggatatggaaggaaagggacagtgcacagccggaactcttggaggagatactggagaagggcaacctcaacagagcttttaagagagtaaaggcaaacaagggagcgccaggaatcgacgggattaccgtggaggaaataggcgcatacctgagggaaaaccagaaagaacttatcgagagaatcagaaggggaaagtacacccccgacccggtaagacgagtggagattcccaagccagacggcggaatacgaaagctaggtattccaaccgtaaaagaccgcattttccaacaagccataacacagcgccttacaccggtctacgagccgttgttctcggagaacagttacggttatcgcccgggaagaagcgcgaaagatgccattcagaaggtgaaagagtatgcagagcggggatatatccatgcggtagcattggacttgtcgaaatactttgataccctgaaccatgagatactcctgaatatcctgcgcagaaatgtgagggacgaaagggtaatccagtggattaagaggtacttaaagagtggcgtgatggaaaacggagtagtcatggaaacagaagaaggttcgccgcaaggaggaaatctttcccccctgctggcaaacatctatctgaatgagtttgaccaggagtatcagaagcgtggagttgtatttgtccgttacgcggacgacatcgtgctgctggcgaaaagcgagagagctgccaagagactgctggagacgagcacgaaatatctggaagggccgctgaaattgaaagtgaaccaagagaaaagccgtgtagtcagcgtgtttgcaatccgaacttttaaattccttggctttacattgggaaagaacggaaagggcatatatgtccgggttcatggaaagtcatggaagaaaatgaagtcaaagctgaaagaacttagttcccgaaggtcagttcagagcatacgccctgcattagcaaagataaaagtgtatatgtgtggctggctgaattattacgggattgcggaaatgaagaaccgaatagaagaactcaataagtggctataccacagaatccgaatgtgtatatggaaacaatggaagaaaccgagaaccaaggtgaagaacctgcggaaaatgggagtgccggaagatttggcatggcaggcaggaaacagccggagaggatattggtttaccacgcaaacggtagcggtaaatatggcaatgacaaaagaaagactgataagcagtggcttttatgatttagccatagcttatcagtctgtgcacgtcaactgttgaaaccgccgtgtaccgaacggtacgcacggtggtgtgagaggacggcggttaatcaccgcctcctactcgattgcattccgccagactgtccatggcagggattaaagcagtgatgcagtccatcccgcaggcggccgccgctttcctcgtctcctccccgatacagaccgccttaaagcctctcagcatctcagcggacggcttcagcgtttccataaaccctctgactgtggaaccgcttgtgaacgtgacataatcaaagcactgtcccgtgagcagctttttcacgcgttccgtctgtgcattgcagattggataacgggtatggtaaagggcgatatcccggtactcgatcccggctttctgcaatggctttatcaattccggagagcccttctccgctctcagtatcagaatccgttctccttttgctatctccgacaagccctctcccagatccttcgcataatactgtccgggcatgtagtccggatagattccgtgtttcacgaacatttcacccgttgcccttccgattaccgcaagctttacgcccgcaagggcgcggatgtccgttttcatctctcccatcagttcaaagaagacctcggctccgctgggacttgtgaatacaagccagccataatcgccaagccgggcaagcgcttcctgtattgcgctccggtccttcggcagttcgatttccacggcaggcagttccaccacctccgcgccggcagcccgcagccgggccgtcatttgggacgctctttcgcgaggccttgtcacaagaacctttttccctgccagccctctctccccggaccaggaacagactttggccaggttacagacttcaccgaccacaataaccgccggcggccggatccccgcttccttcccgtcctcaataagcctttgaagcgttgacagcacagtcctctgacctgccgtcgtaccctcctgtaaaaaggcggccggtgtgcctcccgccatccccgcttccatgagtcctctgcagatctcaggggccgctccggcacccatcagaaaaatcagggttcccccggctctcacgagggcttcataatcaatggcgccttcattaccggcctgtgaatggccggtaatcacatgaaaagaggatgccaaaccgcggtgtgtcacagggattccgctgtatgcggggactgcaaccgccgacgtaaccccgggtacaatctcaaaggggatattattttccctaagcgcctgcgcctcctcgcctccccgtccaaagacaaagggatctccgcccttcagtctgactaccagtcctcccttctttccctcttccaccagaatccggttaatctcctcctgggaagcggagtgaaagccgcttcgttttcccacataaatctgttttgccgtgcccggtataaagcccataatcccgtcgcccgccagggcatcgtaaataacggtgtccgccgccgccagcagttcccgcccttttacggtcatcaggccggcatctcccggtcccgcgcctatcaaatacacttttttatcaaaatattgattttccacttccgtctccaatttctgtttataatctcttttactttaagtccttatttttgctcaaaagcatttttcagcgtaagcgccagcttcaccccaagctgctccgcctcctccgccatcccttccatctctcccgttatataacggtccgatacctcgtcgtaataaaggcccctgagatacagacggccggctgctgcttcggcgcaggccgcgcagggagaactgcatccgccgtccagtattctgacaaatgcccgttctgctagagccattgcccgggaatcgggcgcatccacctccttcataaacggaaaataatcttcttttctaccctggaccgccataattccctggcctgcagagggaatgatctcatccacagaaaaataacggctgattcttccctcaaaccccagccttataaggccggcagccgccagaatcagggcgtcatactccccgtcgtccagtttcctgagcctggtgacaagattgcccctgattcctttaaacaccgcatccggatagagcctggccgcctgcatcctccgccttctgctgaaggttccgattaccggcccggccggaaggctttcaaggcctttgcggagcacaagaacgtctcttttatcctcccgtttcgaataggccagtatcggcagccgttccggcacctccatcggcatgtccttcagactgtgaaccgttaaatcacaccggccatccaggagcgcacgatccagctcctttacaaaaagcccttttccgcctatctgctccagagacttatcaagtatcatatcccccgttgtcttcattgtcacaagctgtgccgacacgccgggacagacccgctttatctcttctattatcagttccgactgaatcactgccagaacgctctccctgcttccaatccgaatggttccgtttatcatctttctatctctcctcctgtcatttcccgctccaggcacttctgcacggcctcggtcattcgttttgccagacggtgatcggttcctccggccgtaacgcctgccacaaccggtccctgctttgccagacccgggaaatagaaatccgacatttccttttttcccgcaacattaacaaaggctccggctctccttccgtccagagccgccaggcggtcggcctccggatccccggtggccgccagaacgaggaaccagcctccctccccggcggggccggccttctctgcaagcggataacgttctctgtattccctgtaatccatcctgtacagatttacgaatccgttttccgaaagcttccgaaacagttcctccgcctggccgccgacctctctcgcaactacggtaaccgccgcgccggactctgacaaagccctgatccgtctctgtgcgaccggaccggctcccgttataagcacattatagttctttatatcaaaaaacaaaggaaagtaagacatacctccaccctttctcttcaattcgtcgtttctgtgcaaaatgcgcacgataacacctcgtgggatactacccgtgaacagtaacgctttcatcccattatacacaaaaagccccctacattcaaatcacattttaacgcttgcggctttatccgtttcacggtatacttgtacggtatacggttatgcaaggcagtactaaatccgtcagtaaatcatggaggtaccggtatggaagaatttttcaaggctattgaggataagattggcgcatctggctatccgggacaggtgagcggtgaagaaatctataatgaaatctgcgacgacattgaggaaaaggagaacggctcctatctctttctctccaaaaaagaagataactctgtttttgagtataaagtcgacgtaatggatgataacttcaatctctcttatgttcatatcacgtcaaaatcaggcacgtttcatatagattttgacatataattcacaaacaagccgcggaagctgcctgctattttcacagacagcttcctttttttgttcctaattttgggaattatcctccttgttttatacagacacttttgttataatatgattgttaaaacattaacccattttccattcagaattaaaaggagggtttatcatgaagattcaaaatatttcagacgtaaacaaattttttgccgttattgatcagtgcaaaggaacagtcgagctggtatcaccggagggagatcgcatcaacctgaaatccaaactgacccagtacctgtccatggcaactatcttttcaaacggatatattaaagagctggaactggttgcttatgataaagatgatatcgatcgtcttatcaaattcatgtaccaaggagaataagagctgtaacagttcggcttcggccagcgttacccggatacagccgtcccgcagcagattggaaaccgttaaaaccgtttctcatccgccgtgggacggctgtctttatattctcccggattaccgccgtttcagcctccggttcacatcctcccttaccagtgcataaaccactgaacaaagcgggataaatatcagcattcccacgactcccatcatactgccgccgatggagacggccgccagtacccagatcgaaggaagacccactgagtttcccaccacatggggataaatcaggtttccctctatctgctgaagcacaaagaaaacaatcgtaaaccagacagcctgtacagggttcaccaccagggtcaggaaaattccgattgcacagccgataaacgcgccgaaaatcggtatcagcgctgtaaatgcaatcagcactccgattaaaagcgagtaaggcagtctgagcaggctgagcgtgataaagaacattgttcccagtatcaccgcctccgtacactggcctgcaaggaacttcgaaaaggtctgctccgccatgcggcagatgcggataaattcatttaccgcgcgctccggaaaataagcataaaacagttttttaaactgacgggccagattttccttctgcaaaaggatataaattgcaaaaataaaagcaattccaaatgtggcaattccgctggcaattgacattgccgccgtcaatgtggacgacagcaccgtgcctgctccggtcgtgacaaatccggctatcttctcaaacgtatctttccagtcaatctgcagattgatattgttgatatattccacaatctcagggtactcgccaaatttcttttcaagcattacctggacattcataaaaaactgcggaatcaaatcctttaagcttacaagcgtatcggttatctgaggcactaccaggaaaaatacgattcccagaatcagtattacaaagagaagtgcaaccgtcaggcttatcactctcctgtgctttctcactctcttctccggaagcctcgtctcaacgaaccgcatcggcacattcaggatgaaagcaatggccgaaccgcataggaacggaaatacaagccgtatgatccagcctataaataccagtactctttcaaactgcatggcaagcgccagcactatgaccgtgtacaggattaacagcataatttttttcattgtttcccggtttatatccattctgtttcctttcaaaatatctcttcaaatacatttctgatttcttcttccgatgccttaaatgttccctgaatcatctgagcgcttccgccgccccgcccgttaagctttccgttcagggtctttccggcctgcctcatatcaaatgagcggctgcccgcacagtaattaaaaccgcctttcgcatcctctgagaaaacggctgccgtctctgccttaccgccttcaagcagccggtcgcagaactgccttatctgcagcgccgtcatccctgtttcaaatacaagaagcagcttttggcctgcctcatactgttttaccttcaggttgagcagctctctcgtaagcgctccgatgcgtgcgtctttttcggccgcttcgtttttcagacgctctaccgcttcctttagcctgtctggttttgcagacagcaggtttgagatggctgcggtctgatccgtcttccttctgtaatcttccatggccttagcaccgcagagcatggatatacgcacgccgcccttataatgaatcatggacaggaacttaaccgctccgatttcaccggtatattcaacgtgggtcccgcagcaggcacagcagtcggcgccgggaacttccacgattctgacccggccgctcagttccttcttacttctgtaatccagcttttgcagttcctcctccgatgggtatgtagcctttatctgcctgttggcaaaaacgatttcgttcgcttctttttctatttccatcagttcttcccaggtcagtattccatttaaatctatcgtcatttcttcatggcccatgtggaatccgacattatcatacccgtaacggccgtggattaatcccgatacaatatgttcccccgaatgctgctgcatattagaaaaacggttatcccagtctatcgcaccggtgacggtttgtccctcctgcagttcctgatccgtgtagtggattacctcctctcccctctcatggacatccagtactctggctgttccaagcgttcccgtatcagacggctggcctcccccttccgggtaaaaggcagtccggtccagtatcacttcaaatccctttttccctttttcacaggagacaacctttgcctcaaactgcctgatatagggaatacggtaatacagcttttccatctttatttcctttctttatcaaattccgcgatactcctattatacacaagttttcaccatgttcaatcatgttcccgttaaaattaattttaaaaatcaggaaactgtggcaagccgccgggcatatgatggagtgtaaagaaaatctcggaggaacttaatatgagtgatttagcagcaacaaactgcggatgtggatgtgagaatacctgtggcggcggatgtggatgcggatgcggatgtggcggaggaaactcgattttcctgattctcatcttactctgctgctgtggcggcggcttcggcggcggtggatgttgtgaacataactgcggcggcggatgcggatgcggatgcggcggtggattcggcggcggatgtgactgcctgatctggattatcctgctgtgctgctgctgtggcggcggcggattcggtggcggcggcggattctgctgctaatacatctgtcccttcaggccccggattgcctcagaattcaaagcggagttcttccgcagcaatccgttcggccggtattctgaaaaactgccgggatttcccggcagtttctttcgttgcaggcgatgacctgtgcgcagagcgtgcagattatcgttttctcactgttctctgtttatctgataaatcagggcattacagacagcggccgcaacattgcttcccccttttcttcccctggccactatataaggcgtatccttcaatgacagaatcagttcttttgactggacaacattgacaaagccgaccggtacgccgataatcagcttcggcctaagccttccttcctgaatcagctcatagagcctgacaagggccgtcggtgcgttacccacagcaaaaatacagtcgcgccccagtcccgccgccttctccatactggctgccgcccttgttgtcccgtcgctctttgccttcccggccacgtcctcatcggccataaagcagaggacttccccgcccattttatggagggactttttgttcactccggcttttcccatatttgtatcggtcacaatggtacagccctctcttaacgcctcaagcgctttttccacggcgccgtctgaaaatatgagactgtccgcataatcaaaatcagcggtggtatggatcacgcgtttcaccacctgctcctgcccggccggaaaggtcctgtctcccagctcttttgttataatctccaggctccgtctctcaatctcctccggcagcacctgctccaattctatcatcgcaaaccatcctccaatattctgtagactgcctccatgtcgaggctcgttcgaagctcctgcgccagcttgtcgtactggctctcccggtaagcatgataatcaaagtctccgttctccgtctttaaaccggaaatccccttcgcttccagaagagcttctgtaactgcggctgcaactcccggaccgtcaaagattccgtgtacataggtaccatagatatttccgcaggccgttccgtctcttttaccggcgccggcaccgttctggtactctgtcagtgaaagaagggaggtcccgttttccctgatctttgtcttacccatgtggatttcatacccctccgtcttcattccggacaggtttttgaagatacccggcaccgcctcaaaacggcccgtaatcctggtcctcgtcttttcctcgtgaaaagacgttaccgcaccaatcaggcccatcccggccgccagctgtcccggaatgccgttttccgtacctgcttcatccaccaggctctcccccatcatctggtatccgccgcagattccccagatcggtgttcccttcgcggccgctttaaggatcaatgcctccaggccgttctggcgcatccacagtaaatctcccatcgtgttctttgtgccgggaaggataatcatatccggtctgccaagctccgaagaccggcttacgtaccgtaccgatgctcccttcatcgccgacagcacatgaaagtccgtaaaattggacagtctcggaaaacgtatcaccgcgatatcggcaaaaacaccgtgttcctgccgttccccggggaaaatggccgtcagcctgctgctcaggctgtcctcatcctcgatatccacatccatgtacggcgtcactcctacgaccggaatcctgcataagtcctctatcatttccacacccggatcaaggattgacttatctccgcggaatttattgattatcaggcccttaaccatcttcctctcctccggctccagaagcatcacagtgccgtatagctgggcgaaaacaccgccccggtcaatatcgccggccagaagcaccggcgcctttgccatcctggccattcccatgttgacgatatcatcactcttcagattgatctccgccggacttccggccccttcaatcacgattatatcgtatttacggtcaagacgcccgtatgcctccatgatggaaggtaccaggctctttttatagcggaagtaatccctggctgccatggttgcaaccggaacgccgcttacaatcacctgggaaccggtatcactggacggctttaagagaatgggattcatgtccaccgaggggctgaccttcgcggcctgggcctgcaccacctgggcgcggcccatctcaagcccctcccgcgtgatgaacgaattaagcgccatattctgggacttaaaaggagccaccctatagccgtcctggcaaaagattctgcacagtccggcggccagcaggcttttccccgcatttgacatggttccctgtatcataattgcctttgccattatcccttccctcctgctgccttcatgcattcaagcagcgctttgttctcctcgtgcagtctgacggagacccggtaatatcgtttatccagtccgtcaaagttttcacaggaacggattaaaatccccctgtccctgcaaaattccttatagtcaaaacagttcccagacttaaaaaggatataatttaccattgagggaaacacggtaaatcccatacgctcaaggccgtcagccagaaactgtctctcccgctccaccgcagccaccgtcctgtcaatccacccgccgttcacggcagcctccctcacggcagccagagcggcagcctcggccggcgccgatacgctccagggctggcggcagcattccatccgttccaaaatcatctgatccgtacagagggcatatccgaaccgaagtcctgccatggcatatacttttgtaaatgcattgacagccatgacatgcccgtattcctccggccgtttctttatcagtggaatcacggaaaactttgccctgtcttttaaaaaccagttaaagcattcatcgaccacgagaaaaatccctttttccctgcacagaccggccagtctgtcaatccagccgttgtccgccgccattccggtcgggttccccggattgccgataatcaccatatcggtgccggagctgtccgcaacgcggcttaaaaaatcccgctccccgccatccagtgcaaatccgtactcttctcccgggtaaaaccgttctgttttacagccggcggccgagagggccgtctcgtattccgcaaaggacggagaagggacaagggccttacccggccgcagggcaaagaccagcgtataaaaaaggtcggatgctccgttgccgcatatcagatgctccggcttaatcccgtccccgtaatattttgccagagactgcctgatggtccgggacaggctgtcgggataccgctcccagctttgctccgaagcggcggcagcttttttaaccgcttccggcatgccgaagggattcgtatttaccgaaaaatccagtctgattttattgtccgtatagatgtctcccccatgcagatattccacttcgccgtccctccatatcctcgtaaactatcaaatccacattcctgccaaagcctgccagataagcgcaagtatcagcgcgaaaactgccgccgcatacatcagccggttcgcccttctgatgtcctcatattccacagggcgcagcgcatcaccgataaatggttttttacacagctccccgaaataccaggcatcgcctgctagcctgatatccagcgccccggcgcagacggattccgtctgtgccgaattcggactcttatggttaaagcggtctcttttaaatatgcggcaggcatttctataatctaaccggcacaccgccgccgctgctatcataagcagggcggacaggcgggagggaagaaaattcgccgcatcgtcaagcctggccgcggcccggccaaaccagaaatattttttgttcttatatcctgccatggaatccattgtattaaccgccttatagacccagcccagaacaggtcctcccaacgccagataaaaaagaggggcaatcaccccgtcggaggcattctcagccactgtctccacggcagccctggctatgccctgtgcgtcaagcacactggtgtcacggcctacgatcatggagacattccttctcgcttcctcaacatccccattccttaaagagtaatagactctcatgctctcatccctcagggaacgggccgccaaaagaaaataaaccataactgattccgccagaaacaacgccgtgttcccggccgccgcagccgcataccataaaccaaacgacaatgcggccgtaattccaagcaccagcagaacgaagagcgcccccccggccagttctcccttttccgttttagggaacaggcggcggattcctttttccgaaaggcttatcagattcccgatgcctctcaccggatggggaaggaaatggggatccccaaagcaggcatccagaataaatcccgccaatgtcgacgccatatgaatctttacactgtccatgatttatctccaatgctgttttacgttttataatggtacggtttacacggctgcgttccgcgaagcgcgttattgttcgcagcgcaccgcattttgtcgggacgtgaacaataactatttaatcctgcttcccagtccgcatacgacgcggtagacctcatccgaaaaagcggcgattttctggcagacacggccgtccttctccctgtattcccgcgcaaatgcgtcagccggaacgattccgcagccgatttcatcggccaccaccacggccccgccgttcttttctatcagctccccagcaaatacggcgggatctgtcccttcctgcattaaccgcaggacataacattccagatggagaatcagctcagcctccagagcttccccgtagtcggaacagcgcccgtcggcggcggctatgtccttatcctgaaagaagctgtaggcaaactccgtctttccctgggcctgtccgcctgtaataaatatcatatcacgactcttcctttccgaacttctctgtgtttttccgtcattcatgcagctccaggggcagtccgtcgggatctttgaaaaatgtcatctttttattcgtaaattcgtccacccggaccggctccgtctcaatgccggcggcatttaatgcttctaccgcttcctccatggaatccaccttaaaagccagatggcgcaggccgcaggcctccggataattcagccgggcaggactgcccggtattccgaaaatttccagctcgcagtcccccagctttaaatccgtactgaaattctttgattgccgtttttccttgatattctaggcttttttgccctttcggttctcggttgtcctattccttaaccacaaaaataggtgttttttcaatcagaagcccctctgatgtagcgcatcatttaccacctcaaataactcctcaggcttattgtactttacctttgcatagatgtccatagttgttttgctgttttcatgccctgcaaggtactgaaccgtcttaggattcactcccgcatagagaagattggtaatgtaagtgtgccgcagctgatgtggtgtcacatcaaaatctatcgtgtatttgattttgggttggttcttctgtgtcatgcccagcgttggagtaaccgtatatttgatactctccccatttacatacttatagtagttccggggcttagtggaacggacaactacatactgccataccctctgaaactgtgaatatgcaagcggctctcctttgctgtcagcgatcacataatctgatatagaattttctttcgcttctcgcagacaatctaccaagcacttcggtatcggaatatccctttttgctgccggggtctttagcaccgtagaaaccacgggtctgttatgctctgaccgccatgctctccgcacggatatatacggagtaggtgcatccagaaacacacaatcccagtgcaatccaagtgcctcctcccggcgaagcccagaatacaagcaaatcataatgaacaaatagggtggcagccccttgactgtatccaataacacctcaacctgctggtcggttaatgcgtctttcttcttcgttggctttccgccctttgcagatattcctacacagggattataagtgatcagctcactacgctctgccgagtaaaaaatacatttaatgagcatatttaccgtattgtataacccctccgatttgttggtcagcggcacaagcgccagacgaatatcatctgcggttacttcctccatatacatatcccccaaaggcttaatgatataattcctcatgtcagaggtatatgctttcatcgtagctgaagatacctttgctgattgcatcagcagccatttctcacaatattcagcaaccgtcggatgctttcggcgaaaaacaatctcctcgacctgcttttttgctgcctgctgtttttcatatagttcttcacaagtggtcgcatacaagctgacctgcttgccatccgcatcctgaatccgtgttctgtaatataggattccttttctcataacagttccgtactgcggaacacttctatttttctttgccatatagtttttcctttcttgataatgagcgtttacaacttacactctcgttttatcagaaagcatgaatttaatcaaagatacggattgaggaaaatgaagagcgagacatccttgcctcgctcttaactaattatgatgtttcattgcttctgcactttaggctcaaacaccatcccactgagcaaatgcaccgcccatgcttttaaccagctcatccggtcgattgtatttgacttttgcatagatgtccattgtaatcttgctgctctcatggcctgccaagtattgtactgttttggggtctaccgatgaatgaatcaggttcgtgatatatgtatgccggagctgatggggtgttacctcaaagtccaagctgtaaaccacttttccgttatgagcagccttttctcccaagacgggtgtgacagtatgctttactcttttcccatcttcgtatcggtaataaaccctctcctttgttgttctggtaactatatactgccagagccgcttgaactgcgtgtaggacagcggatcgccatcacgatttggaacaacatactccgaagcggagtttgcttttgcttctctcaggcagtcagccaagcagatagggagaggaatatttctctccgctgcttttgttttcaattcatcaagaatgaccggtcggttgctttctgtgtgccatgcccttcgtactgtcaggtatggggtatccgtatccagatatacagaatcccattgcagggcgaggatttcttctctccgtaagcccgcgtacagaccaagcatcacaaatacatacggcggaagcccttgaatggcatccaataagcgggctgcctgctcatctgtcagagcttctttttctttctgcggaacccctccgccttttgaggtcagatagaccgtgggattcttatcaatgatccggctttcctttgctgcccggaaaatagatttgtaaagaacaaccacagacttataaaccgaagccgatttttttgaaacaggaacgagggcaagctggatgtcatccaaagtcacatccgccatccccatatcacccaactctttgataatgtgccttctaactttagatgtatagtcagtcattgtggtagcccgcacatgaaccgactgcatcagcagccatttctcacagtattctgctacggtaggagacttccgacaaaatgtatcattgtcgatctgctccaacgcattcagttccttatcatataattcttcaggtgtccttgcataaagagccctcaattttccatctgcatcctgaactcttgtcctgtaatagtcaagaccgttcagcgtaactgtaccgtattgtggaatcgctcgttttctatttgccaattcctccacctcctaagaatgatctccagcgctgtacctttgttttatcagacctctctgattccatcaaggatacggatcggctcacgatcttccgcttcgaggcttacggtaagttgtgcttctctcaactggctttgctctatgcgtacatttggcgatatactcctggagacctgccgcagtaaaatatacacagccattctgaacatattgcacataagagatcaagccgttgttacgggcggcatccagcgttgctatgctgattcctaagatttcagcagcttcttttcgtgtaatgagtttttccatagaccatattccctccaatctgtcaaggttatcatcttgctttcaaaaccacatgaatacgctggcaaccgaaactgccagcgcatggtatctgattttgaatagaaaacggccacctaagaaagtaatcgcttcctatttttaatgcaactcaattctcgccacatttgccacgcacccctgacgatggggacattccggtctccgctggcgcggctgtcataactccgcagcgtcgttttactcgtgcgccgcagggttccccccaagtctttaggaggccgtgaggaagtatctttaagcccccatgcagtcatcgcgccccgaaatgccgctttcgggtttcaggcttgcgtagattgctcagaacagtcttgttcatcacctcctggactgtcatcttcgcggcgcgcctgattcgctcgtacatgggttatgtaccggaaatgccgtctattcagttgtcaagctgcatgagggagatagaccctctcacttacttccccgttgggagagcagtttagcaaccgattttagaaaaattcttcaaaaatttttctcagcttcaacagtagaacccgttttctcttattgaccgcctgatgcgaaatgtgcaatatattcccgacttcctgttctgtcttttcttgatagaaaagcaggaaaatcagttcttgttcgtcttcgtttaattgagccaaacaaaagcgtatctgttccgcttccagatgttccaatgcaagctgttctacgttttttccgggcgcagcaaactgcctgtccttttccaacagacgctcataggaatcctctctgctgggcaggaaagatgcagtgtctttctggaacttttccgttttcagatcgtaggaaaagtattcttcttttcgctcgtagtgctgatacacgcggtaaatctgttcgcttaccggtacagcctgtccatctatataaagataataattcgctctttcttcacgatttttgctcacagccgttacctccaagagtttgaaaagtggatcgttttcgaactctcggaaggcggcgaacggcagcgtgggaataagggaaaaataatacggacacaggcacaggaatatcccatgtcggtgtccgttctgttttgtcgctttctaattgctactaatagttcccataaaggccataaaagactggcagggaagaagcgggaattttggggttctggcgtagttttacaaccaggttttcttcgttaagaggacctgccagaagcggacaggtcattattttcccacataatcatctcctcctaagcaaaaaaacaacgcatagtagctataaaaaagccactcttcaatcatttcgcataatacttttaccccgtaaaatataattatgtgaggtgacggagagtgaacaaaaaaatgcgacatatagatttttcgtttggggcatccttacggaatgccagggaaaagcgaaactacaggagagaacagattgcggaacgtgcagaaatcagtcctcgttttttggcggccatagaaagcggccggcgaaagcctagcttggatgtcctgattcgtcttgtcaatgccatcggcgcttcgtttgacgaaatccttgcgccgcagatgatcacagacagcgaaatcgttgatcggattaggcgcttggtcccacaatgcagtcagcgagatcaggagctgttgctcgccctgattgataaaatgctggatacaaaagagaagaaagataacaaataatgcggtcgggtgtattgcccagccgcattatctgtccgttgctatacgggcaaactgtttttccttttgagaggaatagtaatccctgagtttctcaaaggcttctatactgatagtatgttccatatggcaagcatcggcctccgctgtcttaggattaacgcctgcggttattaactgctccatgaagaattaatggcactcatagattttttcgggcaccccgcagccaatatctgctagatgtaggtatgctcctttgcatactgatacaaaactactttaaagaaaaacaatattgacagcattcttccataaactccggatcatgtgtgataacaatcacggtttttccgcggctggcagcggctttcaatgcatcggatattctcctcatgtttgcgccatccaatccacttgtaggttcatccaacaagagtatctcacgctccgaaaatatagcgcaggcaacggcaagtctctgtttctgtccccctgacagggctgccggatgtacatcccgatactcgtacagattcatgttctttaacaactgccttgccctttccattcgctcctctgacaacggttgattcaagagcagctcttctgaaacacttgcggtaaagaactgtgttgtcgtgtcattgccgcagtagtatactttttttcgccttctagacagatgatttttactcccacaaacgatgatgtcaccgccgctcttcttagagagacctgcaagcactaaagccagagtgctttttccggcgccatttcgcccggtgacagcagtgatagaaccttgggggaaagctcctgaaagatttgtaaacacctctatttctccgcattttttacacaggtcgtgcataatcagcgacccacgctcgaaaagtttcggaagtggtagcggttcgcgtgtttgtacacggtgcatcgtccgaagccccttgttgcgccgttccatttccggcatagctgtgaactccttgggagtgtattcgcgtacaatcctccctttttccatatatataatccgatcagcaagctcagaaagccatgagagacggtgctctgcgatcactaacgtgtagccctgggctttcaacttaaaaagcgttcccaatagttgctcgatcccccctaaatccaaattcgcagttggttcatcacaaacgaatactttggggcgcatggcatagacggaagcgattgccacgcgctgcttttctccgctggaaagcacatccagaggtctttttcttattaaggaaagagaaaaggtttcaatggatttatccgtcctctcttgaattgcctcccgggagaagccgtggttttcgcatccaaaggccacctcacccacaagttctgatgaaaaaaactggcttttaggattctggaatacacttccgacgattgttccgatttcccaggctgtcatccctgtaatgtctctatcatctatacaaatacttccggaaatggagcctttgaaataggatggagccagaccgttcatcaatctggtcagagtcgttttcccgcagccggacactcctgtgagtaccacacattctccctgtgctatggatagatttacgttccaaatttgctgttcgctcccctcatattgaaaggatacgttcttaaattcgatcaaattttcacacctccaacgcaaagaactgctgctgtaacgattccccaaagcgcaaggaaacaccagtcgcgcatatgcatcgttgtttcgtagtaactctttcgcacgccagggcactcagcgcctcttgccacagcggaaacggccagttggtcggcaatctgcaaaatacgtagcagaagtgggacaaggacatattcaacacttgcaagtggatgtactgcaaattgtcttacagatgtaaggccccggtttttcatcgaaaggcccactgctttaagctcagccttcatggtggggaaaaatcgaaatatgaccatcagtcccaatatgacgccagtgggcatgtggatacttgacaagaacgacgacagttctccaggaggcgtcataaacaaatcccaaaacagcatgagcattaccatactgctccagaaaaacaacacaaggaattcggaaataatgaccgtatgatatccccagaaccgaatcgcgtacaaaagcaatgacaacagcagataaaaggctccacaggatgtcattaatcggtagtttctctggaatccaacatacacgaagcagaatatcaccaaaacggtggtaaacagaatgtttttcaccagaaaaatacctagcatggcgcagagcaatgcaaaaaacttggtcgggacagcaaaggagtgctcacctctcatagaacacccgctttcttgaagtgtttcccaatcagccgactcccaagtatactgcctaaaaagccacagataacagagaaagatacaataaagatcagccagccgggggaggtgtaatattgtatgtaactgtcaatatagctttgatccatgccgcttgcgacggcaaacgcgtaaaaagtgtcccagaaaaacaaaagcggaagaagattgcctccattataaaacaggctcaccatcgcccatgcgaaggttaatctctttgcgttgcgacaggatccccgcttccatagtaccacctcgcatagtaggcctaccaaaacgaaataagttgcctgtcagcaaaaaaaacacgcccagaatcgtcagatacgtcaaagaaacgaatcttttatttaccctgctgaccatcagcatgtacaccggggcagagaaaaacattgataccccaggagataaaacgcagttgaaaaattgatttaccatagagacagtaataactacaaaatgaatgccgatgagaagcaccgtcaataatactgttgtaatcacatccttgactgtccatttgttgtttgttttcatatgattttcctttcttcattatgaatgagaggacaaggcgcgccaggaatgacggtcaccccgttccctttacgttaatactggaattcttccgtcagttttgctttctccaccaaattgttataggttggagaagctttaagcagttcaagatgagtaccggacgcctccactctcccgcagtcaatcaccacgattctatctgcattttcaacggatttgagacggtgggaaataatgataacggtcttatccagaatgaggcggttcaaactgtcctggatctttttttcgttttccacatccaaagaggctgcaatctcatccagaatgataataggtgaatctttcaaaaaggctctggcgatggataaccgttgacgttctcctccagagagtgttgctccattttctccaatcatcgttttatacccatccggaagcctccggataaattcttcgcagttggccaatcgtgctgcctgaacgacttcctcatctgtggccgtctttttcccaatacggatattttccagaacagatgcattaaacagcgttacatcctggaacacgatggctatcttttcaaacaaggattttgtagagatttctttgatatccagcccgccgattcgaatgcttccgccgtcataatcataaagtcttgacatcagacgcaagatactggtttttccacaaccggatacccctactaaggcagtcacctcgttttgcttcgcggtgaaactgatgttcttgagcacttccgtatccttatcgtaagaaaaagacacctgatcaaattcaatatcataacttgagattgtctgatccttgccctgctgtatctttgtctcccgcacctcccggatacgtttgaccatggaatccagataatacagctctgccacattcatgctgaccgcttctacgctttcccgcaccttaatggaggccagtacatatcctaaaaagtacaggatattgatctctcctgtatgcagcatttggacgcctatcaggatcacaagcacaaaggcaaattgcagaatgacattcgagcacaacataggaatacccgctgaaatctctgcacgaagatggattttctcactttcttccatcttttgataaagagtctgccggatcttctgagtcaagccaaagctcttgatttcctgctgattttcaatggcctcctgaaagctctcagagttgtcccggagcttttgataatgtttgaatgactcccgaatctgaaggtttttcgacaataaaagaagcccgaatccaagcagaattggcagaatgatagcaagccccaatttaacattgccaaggagcagcagaaccgaaagcaacggaaaaaagaacaggaatcccactgcctttgccatagcgtggctcatagcatgctcaatagctgccacatccgccatgatggtttgcgccagatccgaaaggtcatgcctggaaaagtaggataagggcaacttggtcagaatatctgcaatctccgtgcgaagattcgcgctctcctgataagtggtgttatacagcgcatcatattcaattcggagcagaatccacatcacagccagaaccaggatagatccccacaaatacagccctgtttccttgacattgttcaacagcaactcatccaccaagagaagcagcagcattgcagggaaaaagttgatcacatagacgaagaaggaggccgcgctggccttttgcaaatctttggcccccttgtcggtcagggcaaaatgcgttttaaacagttctctcatcttacaaccctccattcatttgcctgttcatagagcgtttgatattctctgtacttggtatcggtcgccatcaacgctgcgtccgttcctcgctctgctattttcccgtcctccaaaaccagaatttcatccacatttcgaatgctggacagccggtgtgcaatcataatgacagtctttcccttcattaagtgagcaaacgccttttgcagctcatgctcattctccggatcgattgccgcgctggcctcgtcaaggatcacgattttcgcattctttagcattgcccgtgcgattgcaatccgctgcttctcaccgcccgacaggtatacgcctttggagccaatcaccgtattttcccgatccttaaacttatccagaatgctgtcgcaacctgcctgatgcagcgcttccatgacctccgctctttgagcgtctgggttcgccagacggacattctcgtaaatactgatgtgaaacaaacggacattctggaacacaaaggcgatattgcggattaaggcgtcctctgtataggcttcaatgggctctcccccaatcttgaccgctcctccatccactttgtaaaaaccagaaatcaatttggcaatcgtggactttcctcctccagaagatcccaccagagcatagctcctgccttctttcagagtgaagctaacatcctccagcaccatctggtctgtatacccaaagcatacccgttcaaattcaatgtcatagtttttgaatgtgctcttgttcccaaatgtaagccgatccttttgcatatctgaaaacacctgctccagtttttcaaccgccgaagttcccatgaatgcatacatacctacatacatcactttcataaaggcggtaaacattactccaccaaggaataacgtcataatgagttccaccgccaacacggcagggtcttgcatccgattcagcgttaaggctgccactgaaacgagtacggcaataaagccgaatagaatcagctggaataacacatatggtctgcggcagctcatggaatagttcaaggcatgccgtgcataatccgcgattgcccgatgcagcgtcttgaaagatgtagcgtctatgccaaaaatcttgagcacctgtatcccgcgtatgtactccacggtctcgctgctcattgtctccagcgccttttggtagacttccataaacttcttttccccggtcatcaggacaaggagcacgccactcagtaggaacagaaccaatagaacaatgcctacccgcagactgatcaaaaaccccaccacaagcgccaaaaacggtgtcagaattgctccagcattgtcaggaatcagatgggctacaatagaatgcgtttgggccgcgttgtcatcaatgagtttacgtgtctttcccgatgagttcagatcaaagtagcggaagctggcattggtcaggccgtcaatcccacgcttgcgcaagttggtctccagccggaagcccaacatatgcgtcaaaagcacggctgcaaaatacaagagcgaaccgccaatcaacagccccgcaaccagaaacgcattatattgagcatgccccatatctccgtctaccaccaatcgtttcaaaaactcatagaggtagtaataagcgcctacattgagcaatgtggacaccaccgtcaggccgattgcaatataggccaaaggtcgctgcttgggcacataatagagcagttttttgtatactgcaaacatagacaaaactcctttcataccgtgtgatcagatttgattaaaagcaagttagcacgagctaacccttgcgcgttattatatttcttcgcaacgtccaaagaggaacttatgtttttaaaattatttcttgcacttcaggataaattcttaattctctttcgcaacaggttttccctcatcttattcccatgatcaaacagggatttcaaacagacgaaataaacaccatgctaatcaataaaagaaattctagacgctgattcattgatttcatctatattctcattgatagtctgagtcgatgcaggaacacataactgacttttcaattcaggtttgtaatttgcattttgatcaggatgtatgctccaaggtgtaatagttcctgtgagtgccaaaagtttttctaagcttgtttcaattgaaaagttgttggattgcatccaagcatcatcaagtaaagtttgaatgtaacgatcccctccatcagaaataatgcacacgacacaatcgtgcggagaaagctgtttagtgattgttaatgcgaccaaagcgcaagctccgccggacggccccatcaaaacaccttcatttctggcaaagcatcttgctgctacaaaagccgcctcatcagtgaccttatacacagaatcgatattctcgactgcaacattgcacggtgtccatgccagtccaataccaggaatcagatatgagtgtgactcaccgccaaaaatagaggacccaacagcatcaacaccgatcacttttacgtccggcctatatgttttcgtgtatcgtgaaatcccacccagttgtccgccagtgcttactgcggccacaatagctgcgacattatctgggcaatcagcaaagatttcacgtgctgttccttggtaatgcgcagtgctgtttaacaggttgaagcactgatctggacgaaatgcatcagggatttcactggccaatttattcgcaagagaaatccttgttttgtgataactgccggaatcatcttgttctgttacaacaataacctctgcgccaaagcatttcaggagagctaagttagtcgcagtggttttaggatcgaccagaataataactcgataccccttagcagctcctatcatcgccaaggatattccgaagtttccacttgaggattctataatggttcccccgggttttaataatcctcgtttttcagcttctgtcacaatgaacaacgccggcctgtcttttatgcttcctcccggattaccacgctcatatttaaacagaagtcgtccttccgtagaagcggtagtgtttctaagttcaatcagcggagtatttcctattgtttccagcaaatgcattctatcaccaccttatttattatttgctcttttaggctgtacatcgaaaactacccatttataccagcctgctaaattatgatacctctgctatgtgtagttcgctgctcaacaggcagtgtgtaaactcgttttccgactgagcggctaacctgtctgtcgaaaccatatctacaaaaaccccattgttcataattgcaactctttcacaggaatgacggatgactcttgcgtcatgggaaatcataatatatgcaaagccaatggatttttggagatttaacaggagatccaaaatctgcttttgcagtatcatatccagtgccgatacggcttcatcgcaaattagaagctcaggctccacaataagggcacgggcgatagcaatcctttggcactgccccgtgctgagttggggaggacgacggtgcagggcatctccatcaatccctacactctttaaataaaatcgagctttttctgtgcgttccttcgtcgttcctattttcaggtatttcaaaggttcctgcacaagctccagtgcagagcgacgaggattaaggctggctcttgcgtcctgaaaaacgatttgtaatgatttgcaaatgtgttgtctcttccttcctcgcagcatggaaatatcctggccgttatacataatctttccctgatcaggcaattccagtccggtgacgcaccttgctaatgtcgatttcccacaaccgctaaatcccaatattccaatagtttcccctttatgcacaagcaagtctacttggtttaagacgtttttgcacttatttcctttttgaaatgcttttttgatgcactcaatcttcaacagcggctctttgcattttgagcatggcagcgaaaaagcgggtaagtttcgcgcctcaatcagttgttttgtataatgttcctttgggtgtaaaagaacatcctgtactgccccttgttccacaattttcccttcatttaaaacaattacgcggtcacagatttcatgaacgacaccaatatcatgggtaattaaaacaatagataatcccagctttttttgtgtgtcccgaagtaactgcagcacttctttttgacttactgtatctagcgcagaagtaggctcatcggcaataagaacttccggctcaaggctgagtatcatcgcaatataaaccctctggcacatcccgccgcttagctcaaaaggataagcattcagtacccgctcaggatcatcaaagttcagtaaccggagcatatcataacaaactttctccatagcttcttttgatggaaatggcttgtttcttagagtctcctcaaaatgcacacgtattgttttcacgggattaagtgcaagctgtgcgtcctgataaatcatcccaatacgcattccacgtattgttttccaattgatatcattgtcagaaatatccacataatcaccgttcccgaaacggacagtaccactatcaatttttgccgatggcggcaatacgcctatgagcgatttcccacaagtggatttccccgaaccactttctccgagcagagcaagaatctttcctttttccaatacaaaagaaattccgtccagcacgggaagtcgttttttgttttgcacatagctaaccttgagttgctcgacagatagtgcggctttcaaataattatccatagcgacctcctaattcaaaatatcaatatgttcatacgggtccagcatatcccgcaaaccttctccaatcaaattaagcgaaaggaccgtaagaacaatgaacaaagcaggacccaataaaatgtgcggagcctgaaagaaatgtgcccgggcgtcagacagcatgcttccccattccggggttggcggtaacgctcccatgcctaagaatgaaagggccgaaacagagagtatcagtgtgcccaattcaaacgtggccagtaccaatagagaaccaatcatcttggggagcagctcaaaaactcccatccgccacccagacgctcccagcacacgagcagcctgtatagacgggtcattctttacctgaagaacgatgcttcttgccagtctcgcaaacggaacccaccagactgcgactactgcaataagtaaattggccaacccagtgccccacagcgcggcaaacaccatagcaaacaccatgaagggaaacgccatcaggacatctataacccgcattatgatcgtatccaaaaggccgcgacttctcatgccggtgataataccaaagaacgtgcctataaacaacgccattacaagggcaagaaagcacgcagtgagggtagtcctgccgccatacagcgttcggcagaaaatatcacgcccatagcgatccgttccaaagggatgtgaaaagctaaattcctgcaatcgttccgcaattgcttcatcgggcgcatagctggtaaaaagaggggcagcgataacaagcaggataataaccagtaatagtattgagccaagtaaaacagtgcttggaatttttctgtttcccatacaaagtcacctcctattgctgtgcagtagggcgggaaattccgcctctgcgcaccatcgggttgctaagtatataggtgatttctacagtcaggttgatcaaaatgactgtagcaaccgtcaacacagtatatccttgaacagcagggtaatcatgtaccaatatgctgttgattgcgtaatttccaattcccggccaattaaaaatagcttcaatcacaacggagccgcctatcatatgtgcaaaggacagggctacggttgtaatggcagggagcagtgcgttctgaaacgctccctgaagaaccatcttggaggtaagtcctcgtgaaagtgccgaggaaacatataactgacccaactcagtcagcattgctgcacgaaccatgcggatacatctgggcgctccaattatccctagtgtaattgcaggcagccacaatctgccccactccatttggctgctaatttcataccaatgaagccgaacagcaaataaaaacagaaacaacaacgacaacacgaaagcaggaagcgaagcaaggataacacaaaacagacggattgcgcgatcctgtaatttgccggcatggactgccgaatagataccaaacagcacacccaatatcgtttcgataaataatgccgccagagcgagagtgaatgttgcgggcactctactccatagttcctgagtgatgggtctgccgctacgaatagaagtccccatgtccagggttatgatctttttgaaccagtttgcatactgaacaggaatactgtcatttaatccatgcgcttcccgtaaagattctctacgttcttcaagcagttccgtgtttacgccaatatcgcccgggccctctccaagtaccaggttgatcgggtcgcccggagcaagtctaactaataaaaaaataacaactgaggacaggagcagagcaagaagagcactgccaatccttttcagaaccatatttctgatcatcatgtcacctcacttaaaaaatggcagcaggagtccagttccgtatctcctgctgccgttttcgatattatttaatcctaagattggcattcaccacattttcaaactgacggaaatgcgggacaaatccctcaagtgaggtgctaacagcagtgatttgcggccttggtgcaatatagagcgcaggggattgctctgctacgtaaagagaaatctcctcaccgatttttatgcgttcttccgtggttgccgcttgcgctagactctctagcattcctgccaattttttatcctggaatcgtccgtaattggctgcgccgtcggcagcgtattgggcgttcagaagcgccgacacatttccgaacgtcccccatgcttcgacagatgcatcccaatcacccgtttcacgcgctgtggtgattaacgaataatctccgtgttgcacagaaacattaacaccgattttcttccactgcatctgaatggtttcgccgagtgcctgatcgtttcggaaagtacgaagcaggatggtaagctgctgtccatctttgtagcggaagccatcctcgtccagaatccagccagcatcatccaatagctgcgcggacttctccacgttgcaggaatcgtaatacgcattttttactttttcatatgtgggattggaaccaagccatgtagtaaccggctcgcttaatccttccatacccagagcaatcagctcctcacgatctaaagcccaacctaaagcctgacgcacacgataatcattcagtgcctctttttcacagttgagataaattgtctgggtctgcgcacccggaaccagtacaatcttcgcctcttcactgttatcaaactgactataagccgactgaggaatatccattaccacatggtatcgtccactcagtgcagcgatgacacgggcgtccgcatcaccaatctgttcatgtacgaccctctggatctcaggttttgtaccccaatagttttcattcttttcaaaaaccatgcactgtgcaggcttaaactctacaattcggtacataccggtatagtctgctgtctcgatgctctcataagtatatttttctgcggtattatgaatgagcaactgtgggaatgacaaattcaaagtaatatccacattaggagtttctgtcacggcctgtatggtctcggaatctaccgcagtaaaatcaatcccttgtaagaaggggttggcttttggatcaagcgcctttgatcgcatcaaggaagcgattacggcttctgcatcggccgggtcgccgctccagaacgtggcattgggatgcagtttgatctcccatgtatattcatcaagttgtgaaacatctttggcaaaatagggttgaatcacaccgtttgcatccgctttgaatagaatttctccagcgcccatattcagcagataatccgccgcaggatatacggtaggatctacgccaatggcaatttcatttcccgcaactaccagttcagatgcagaaatagtagcattactttcagttagagcattgctgctctcatcggtcggttttgcaccgcagccagcaagcattgaaactgccagcaagcagcaaatcataaggatcgatttttgtctatttttcgtaccagtcattttttgcctcctccgtatctattgtttttgtttttctgtttcatcttttggggtgccgaaattcttatacaacataaatccaatcattgccgttcctaccagaacgccatacaagtaccacggcgcattctctagagtgtatttttttgccatatcaaaggacgcgccgccaataatcgttccaaaacctttgccaatcgcaaaagctgtagaattcacccctaaatacattcccaacgctcgtgtatctgccattgatacagcgatattctgctggttcggcctcgccagtatcatgcccactgcgtagcaggccacaattgccataaacgactttacatcggcggcgaacggggtagcaatcaatgccgctgtgatgattccggttccgattactaccgctgcccgagacgagaatcgtttggaagcaagtgctaccagaggatactgtaatactgccatgacaacggcatacaccgtatacataatacccacaccatcagctgagccgtaaatttcctggactcttagggggtatgtaatatcaatctgggacgctcccagccaaaacaccatcatcaaaaggacgaatatttgatatggtctgtcttttgcaattcttttgacagcaggcataaccgcatacgactttgcctgccgcataatcggtggcatggcaacacgtgataatacgaaattaatcataaagcaactcgctgcgccaaagcagacaactttaaaatccagtcgaagcagggctactcccaaaagggggccgattgcgcttgctatccccgtaattgtgttattcagcgaataatatttaggacgattgtcatttgttgtgagcattgcaatcgcagactgatatggcatttcaaaaagaactccgcctaggccgatcaatatcatggcagcaatcagcatcccataggcacttgaaaatgccagggtcagaaatccaagaactcttagaaatacgcccacgctgataagtgttttgacctgaaaccgatctgccaaggcaccaccgatcatcgcaagaccctgctgcgaaaactgccgtattgcaagcgctactgagacggcagtcgcagtaaggccaacgttgttgacataatgcccgataaccagcggcataatcatatcaaatccaaccaccatgaaaaacgtaaaaaataaaagtatgagcaagccgcggcgttgattgatctgcgtttccacgcttcctaacacctccttactgccttagattgcttttgctattacttgaagcctccgcccacttagttcatatccaaattgaaatggacggatatcagtaaatgaactgatatgaggttccggtttatcgaacaactcaacaacctcaaagccatttgctgataacaaccctgctatttcctgcgggaagaaaagacgatgctccaagtgctcaataatcgcctcacgagttccaattttccaattatagtcacgttttaaaatctgttttgctaaatcaatgtaaaagcgtgtttttacaattgctggtttaccatcgaatatcgcttcctccaaaagctcgtccgtcaaccatctctgtccctcctttgttaagaaaaaagctgcattcctcatatcaagatacaaaatgccgccatctttaagatgctttcggaaattcgtcagagtagaaccagcatcttcgttggtgtagttatacaggaaggtgctcccaacgcaaaccagagcatcaaatgtctggtttaggtcaaacattgcctgttgcccaatataaaaattggcgtttggatagtgcttttgtgaccaggcaaccatatcttccgaagcatctatgcctacagcatcgtatcctttttctcttagaaaagctacttctctccccaaacccgatccaacatccaataccttttttcctgtttcgtatttttggagtatcgcgtgtataaaacgcgccatttcaaaagacttatcgttttcaaacacagcatacagttccggattggagtgcagcaagttgtcggtatttgtttttaaacgaatcaattctagtcaccttatcctttgtagcaaaaaacacgggtcgcgtttgcactgaattgcgaaaaaggaaacgattccgctaagagagaggtgattccgttgcccacaaacctcgcagcaacagcactgccagtttgcgcataaacagtcagcggaatattgcgctccagtacccgttctacgactcgatcaaaggttccgttgcttagggtcattcctgtacagattaccccgtctgcagaatccaatactttttccatatccttttctacggggtcgccccattgtgttctttccatttgcaaatcgcagggaaggcaggttcctccgcgctttcgtattgcagctataagcgggtttacaaccccaatcaacgcaatcctcatgccctgttctatgttggcaatatcagcaatcaggttgtcacgaaaatccgctttctcggccggggttccccccggtagttccacagcatcgctgcattgcctttcgtgaggatatactgtgccaagataagcgtccattgctgcaattctaaccggcaaacgcgggtcaatcacgcagcttttgagagacttgcctgaaaactctcttcctgcttcaatgcctaattgctccggcacatgagagcatgctccaaagtatgtcccgactctcagtaatagataatagttgtggtatttattaatggagtttggaaattgcgttgtctgataaatataagacgctcctgttacgaaaaaatcagaaacagagggatccatatctccattcacgatagcaccccataattcattaacatttttatattgcttcatgtactcgctccgtttcctcaaactcaatttccaaccttctcaatgcagtttcagcgaacatgcgagcgccgtacccatcgcaatctcgcgttataacgtgtcccaaatagcaggcattgtcgattggtttttcaatggatttacccacacagtcctcgattctataccgtatgatatttgaatcttcccttaacgtgtcagcgcccttaatctgccttatcttgccgccgcaatccggaacaataaacataatcgcagcactgctcacgttggtatcagatacagtaacggacggttgctgtcctaaagcaagggatacaaaggctttaagcatatttacgccggtcacatattcaatgagttccacgatatagtttcctgctgtacgagggttgatttccaccactttgggaccatccttcgtgagttttatctctgtgtgagcgattccgtggtcatatcctgttgccagcaatacattgcgcacataatcgcctatctcctctttcacgtcctcatccagttttgccgggaacatatgtccgttttctataaagtacggactgccagtcacagacttgtccgtaatacctacaacggtaatctcaccgttatttgaaaccgtctccacactgacttcttctccgcatatatattcttcaatcaaaaatgctcgctctctttcttgatcacggaaattaagcgggaaattctccaaatcacgatatgcctgttgcagatcatttgaagtctgaataagtttaacaaatgcgcttgaggctaaatccacaggtttaagaacaagaggataacctatttcttgcgctgccttttcaacttcctcccaattataagcaagcatgtactttggattggacaatccagcacgatctacagcctgccgcattaaatgtttctgtcgtgcggtcttaacgttggctgaaaacggacacggtacattgtaagcctttgcaacttcacaaaccgtttcgatgtaataatcacacaccgttatcacaccatcgaaccgcacgtgcctaaccgattcgatcagctgttgcagatcgttcgtttctgtttcgacaacatcgtcagcataacggaaaacagcgtgcttttccgagctcatcggattttgataatgtgatgccttccgggttacaaaagtatagctatgtccgagttccctcaataaaggtggtaagaggtttccgcttgctccgacccagctttcaatcataagcaaatgtgccattgctattcctccatttcttttaatagagagcatcatagtcaatgtggttatgacgctcctattgacatattgtagttcttgccatataatttgtccaacgaatagtttttacaaacttaatcggaattattgatagcgtggaggagtacatgaatatagattacctgagaacatttctaacacttgcggagaatggaagcttctccgaaacggcgaaagagcacattgtagtccagtccacggtcagcagccgaatacaggaactggaaaaagagttggggcagagtctttttattcgtagctacaaccacgccgaacttactttagcagggcaggcctttctggaatatgcaaaaaacatagtggaattagagaacagagcaattgatagaattggcttggttggtcagttttctgagcgattgacaatcggaacggtttatgctttccacaagtgttatctggtgcaaggaaccagacgttttttggaaaagcatagtgacatttctgttcgcatagagttcgggcattcaagacatattatttctgctatgcaccaaggaaagattgatataggctattcacatcacccgtttaggcataccggtttccagtgtgatcttgtgtgtgaagatgaaatcatacttgttaccagtaaacaacctactgatctaaatgaatgcataacactgaaagacatggaaacgctgcgcatctacaattcaaatttcctatatgcggatacacataacaggattttttcaagatacaaggcatttcagctcgatatagatataggggaaaatatcgttccatacttattgaatgatgacggctatgcctttgtgccgcgaaagatggtggagcaggaattgtccaacgaatcattgtttgaggttacaattttgaatgaagagataccttcaatgaagaactacgtaatttataaacctacttccccaaaacgaaaactgatacagcaatggctgaacgaagttgtttcggattaaaagggttgttggccgtaaatcgagtaggaggcggtgattaaccgccgtcctctcacaccaccgtgcgtaccgttcggtacacggcggtttcaacagttgacgtgcacagactgataagctatggctaaatcataaaagccactgcttatcagtctttcttttgtcattgccatatttaccgctaccgtttgcgtggtaaaccaatatcctctccggctgtttcctgcctgccatgccaaatcttccggcactcccattttccgcaggttcttcaccttggttctcggtttcttccattgtttccatatacacattcggattctgtggtatagccacttattgagttcttctattcggttcttcatttccgcaatcccgtaataattcagccagccacacatatacacttttatctttgctaatgcagggcgtatgctctgaactgaccttcgggaactaagttctttcagctttgacttcattttcttccatgactttccatgaacccggacatatatgccctttccgttctttcccaatgtaaagccaaggaatttaaaagttcggattgcaaacacgctgactacacggcttttctcttggttcactttcaatttcagcggcccttccagatatttcgtgctcgtctccagcagtctcttggcagctctctcgcttttcgccagcagcacgatgtcgtccgcgtaacggacaaatacaactccacgcttctgatactcctggtcaaactcattcagatagatgtttgccagcaggggggaaagatttcctccttgcggcgaaccttcttctgtttccatgactactccgttttccatcacgccactctttaagtacctcttaatccactggattaccctttcgtccctcacatttctgcgcaggatattcaggagtatctcatggttcagggtatcaaagtatttcgacaagtccaatgctaccgcatggatatatccccgctctgcatactctttcaccttctgaatggcatctttcgcgcttcttcccgggcgataaccgtaactgttctccgagaacaacggctcgtagaccggtgtaaggcgctgtgttatggcttgttggaaaatgcggtcttttacggttggaatacctagctttcgtattccgccgtctggcttgggaatctccactcgtcttaccgggtcgggggtgtactttccccttctgattctctcgataagttctttctggttttccctcaggtatgcgcctatttcctccacggtaatcccgtcgattcctggcgctcccttgtttgcctttactctcttaaaagctctgttgaggttgcccttctccagtatctcctccaagagttccggctgtgcactgtccctttccttccatatccggcggaaagaacggtgcgctctcacatacccttcacgttccgcgctatctctttgcgagcagctatctttgttttctgtacccaatgttctttcctcctttcccagttgtactaaagactcctgttgattcggtccttcatctctcgactactacgacctcggctgacttctgtacgttcagcactatctttcgataatggttatccctttcaggacattccgcacagacctccccgggtaccacacgtctctttctctccatctatctgccacatttaccatacgtgattccgtgtggttattgggcttcgacttgttcagcagccttaccctcacgcatggcctgatgtgatttctgtccgtcagaccagagatttgcccatgggttagtatgttccccacatccggcttccttcagatttcacctcacgatgaacacccttgccttcggctatatccttcccaccaccgggcggattccggactttcaccggttagagacgtgcgccgccgggcgcactgataaacagggagagatagctctttgagccgtctctcccttgtgttattgccattctaagcttgttgagaatagaggagccaaattctatggaactgacttcctctccaacccatagcttatcggcagaatccacgccagtgtaacggaatttctcttgtggagacttacataaaaggaggatggagctataaatagtcttatcctcaaacaactgtgcatccccaaaatcatcaaggcttaccaagtgtcggccttttgcaattaagcttcgcagatgttctcctgcaccaactttgaaaaatttgtttgggacaatataacaaatgtagcctgcatcctttgtttttctgatagcctgctcaacaaaaataaagtacttatcaaattgcttgtagtacttgtcccgaattcggggtaaatctggcaagcaatgccggtgttaatacactcggcccgcagagggaaaaatcctgccgtgattttcccctccgctttgcttgcctggggcagcgcccccaaacccccttgaacgcagaatttcattctgcggctgcgcgttctgcgaacgctttggaccatgaccggcttaccgctggccgtggtctttttcctgttcttttttctgttcctcatccattttcagcagccggtccacattggctttggccgtcaaaagctcccgcatttcttcacgggagcgccggtactcggcgtaggttttcttcttttcttccagcagcttggcatactcggcttgcaggtccttgaccttgggcagcttcttcacacccatctcgtcaaaggcgttttttgccgcctgatgaagcaggatttcttcttcatgttcctcgcggaatttcttggagtaaccagctttccggtaggccacataggtctcgcgggtcttggcataatttacgatgtgggtacgcaggacagcaatctccgccatgcacttttccgctgccttgatctgcgccgacagttcgttgtggtgggcggtggctgccgccgctttttctgccagttccgcatagtccagcagatgatgttcggtaagaaaatttacagtctgcgccatctgtttcaggttaaaaaccttggcccagcgcgcatacccagcgcctttcccagcctgtaattttgcctgaatgtccaccagcagattgaccttgggcggctccggctgcacgatggatttcttacggggcgtatgctgtttttctccggccagtaccgcacggatttctgcttcactgtacccggcccccagcttgtcatccatacgggctacattcttccagccgggtgctttgagacggatcgctttcccgcgccgggatacttcgcagcccatttccgaaagcagcttcagcagcgcatcaaagtctgccggtttctgctccagcgcacggtcaatcatcacccgcagctgctcccgatgggagggcttggcctgatcgcccagccacttgttgtagctttttccgtggggctttggattctccacaatggacagtccgttctcgatacagatggtgtcgctcaagcgccggacggctctggtgctgccccaaaagttgcggaactttcggtcacaatccatattgaccgccgaccagatgatgtgattatgaatgtgcgatttgtctatgtgagtgcagaccacaaaggcatgattacctttggtgaaccgcatggcaaactccacgcccagccggtttgcttcctccggggtaatttctccgggtttgaatgactggcgcacatggtaagcgatcacatcgtccgccccgcgcacccgcccggtggcggcgatatactgccgcttcgcaagcagaaactctgcatcggcagtccggctgtcacagccatagccggtaattagttttccgttgtcggtcttttgcggatttgccacataatcaatgatgtcgctgactgcctgactttcggtgcggcccttgccgatatgcaacggcatgatgcgtgtggttgccatagggggggaacctcctttccaaaaagaaaaggacagctgtgtgagctgtcctttggttaatctgaattttcaacaggctgctgtgcttttaaggctgcaatccgtttggtgtccacaaaatgagttgcataccatttctcaatttccgagtttccgcttttgctgaaccgcagcggaatcaccggcttgtgtccctgcccatttttcttttttacaccccattgcttgtagtaacagaaggagggttttaagccggttttctgtgcgtacacccgcatctggtgcatgatgaatgagagtttgcgcagattgacggtgcagacccgttccaaatagtccacccgtccaaaccgccagtcctcatatttctgctttggcaggacaccgacctccatcagcacatccaccggagccgcataaccacggcgctggcattgatgatagaccgctgaatgtacttttccaatcagttctttttcagtcatggcggttgtctttcttttcgtgccagtttttcaagacagcctctacctgagcaatcagctgttccttatccggcatatagagaacataccgggatgcgaagatattgttggacagaccgcccagggcatattctgccgcgatgctgtctttttccgtacagaggataataccgataggagggttatcgtcagggtcgttgacttccgccgcatagtagtttaagtacatattgagctgaccggcagcctctggtgtcagttttttcgttttcagttcaatcagcacataagcgcggaggattttgttataaaacaccatgtccacatagtagtgggtattgttcagggtcacacgctgctgggttccgacaaacatgaagcctcgtccaagttccaaaagaaacttttcaatctgtgccacaagagccttttccaaatcgctttccaacatgggtttgttctccggcacacccaaaaactcgaacacatagggatcacggatgatgtcagctggctggctgatctcaacccctttctgagccaaagaaagaaccttttctttattcacatcttcactggaaagcagcagccgttcatacagcgagctgtcaatctgccgtttcaactcccgaactgaccagcccgaattgacagattccttctcataaaagctgcgcttgttctcatcggtaatactcaaaagctcgcagtaatgggaccaggacaatttgccagacactgtctggcatttttcataggcaagataaaatgcccgcatattttgtagattagaacgagaaaagcctttgccgaattcccgtgttagttctttggaaagttcctttaaggtttgttttccatagtctgcgcgaatctgattttgctgttcatactccacgataatccggccaatgttccagtaggttgtcaaaagctgcgtattaacctgctgtgcaacattttttctggcgttttccagcagctctcggatttccaaaatcatggagttgtttggcgttaattgattttccatacacgccctcctttatctaaaactatccgcactcggcggcagaatatattcttatatagtatatcctattttttagggaaagtaaaataacatcagtgacatattttatccataaaccaaatcctgaatggcaaacttcaaatcctgcaccttgcccagcagccagatggcagccatcggcagaccaaacgggctaataaggaatgccatcaccagcaggataatgccgttttgcagggagtaggtaatcagaaccgccacacccagcagggcgatcaccatgctgataagccccagcaccagaccggagatatacacgattcccacacaaatccatacaaacagggtcagtgccaaaatcaccggagccactaaaatctttaacaacagtttcagcaaaaataccaatgccctcattgttatgcctcctcccaaaatcacagttcctgttcctgattccattatccctgtctcacagccaaaaggcaaggatacgggcaaaaagaaaaagcggaggaaggcgcggcgaaaagaacgccgttcctccctccgcagatggggtatttgtcccggttacgaaagtttggagagccgggtcagtatctccttaacgccgtcccatagctgttcctgccgctgagatatatcctccagatcggcatcgtagatacgcccggtctcatgcaccttgcgggtcagttggtttaagttgttgctgctccggcgcagcagggataccagttctttcagttccggcaaatccagctgcaccacatagccgtccacagccatttttcgcagataggcgctcaggttttttgttccaaactgcgccattttctgctgaatcaattccatttcatcagcggatacccaaaacagaaccggcacatctcgcttgcgtttggggctgctcatcgctccggctcccgtttcttcggggcggcaggtttgtgaattgatggttcttgtctgagcttttgcaggacagagcttttctgctgttcctgcatggtttttctggcttgtctggtaaacaggtcggtcagaccgggattgaccccatccacaaccagataggcacagtggcgggaagtaccgctgtcttccggcatgggaatggtttttgcccagactttattgtcctgagaaatacgcccgtcacggttcttgtgctggatggtgttggcaagaataaactgtacccgttccgccccgaacttttccagcacatctttgaccgccgcctccgtatccagccggttctctgcatagtgagcgctgatggtctgctcaatggcttctttgcaggcgctgtttgcctgataagaacggttatattgtgccatctccccatgctgggacgcataggcggcagaatgggggtagagaggggcagtccgtaattcttcctgcgccctgcacgcatcatccgcccggttttcaatgctgtcccggatcgcatccatatagccggtctccagcttttcaaaatagcggtacacatctgccagcggagagggagactccaaaagtgcctgtgcctgtgcatcggtcagctccagttcctccatcgccatcacgatgtcctcacggatggcgtactcataggtgtggtgcagggtttcttccgggggctggcttttcagccagtccctgtacttatcctgttcagcggccatcttttcatagagagccgtattcagatcgttggtattcataatcatcgtacctcctcgtgttgttttggtttcttttcagggctgcggggcggcacagggcgtttcaggctgtccagcaccgagggacgcgcgctcttggcagccactgtttccggctgggcgtggcccttgccgtcaatgttcagtaaggtatccagttccaccagacgggcggacttgatccgcagatcgtcctcaaaggggaacggcttgccaacttcctccttggcagcggcctgctgctggtaaaggttctccagctggtttttgaccgcttccagacgctggggcatctgcgccagtgcgttgtcgatacgggtgagatttccgcgcgggtctgtacccagggtcgcccgatgggtcatttgtcctttcagcaggagcgtatattcctgtttccatgcttcaaattccacagacataatgaatccacggtaactgccaatctgtaccggatcggaggttttgacctccttacaggcatccagcagggctgcaccggcgttttctttgtcggtcagcacatcgccccggatctccataccagcaaagccatctgccgggtgtgggtgggcaaccagtgtttccaaatcgacttcaaagccctggatataccccttgttggtttcgatttcctgggggaagtatttgagcagctggtcctccagacggtactgcttgctctggtggtcggctttcatcagcttcagcttggcaacctcaacatccaaatccatgcgctccttgatacggggatctccggcacacagggccttgatctcagcaaaagaaagagccgtttcatccacatcgtcgcaggagcgaactgggcttttgctggtcatgatttgcgaaatgaatttctgcttgttttccactgtctgccagagataagcgtcaaaagtcccctcggtgacatagcggtacacatgaaccagcggattctggttgccctgacgctcgatgcgccccttgcgctgggcaaggtctcccggacgccacggacaatccaggtcatggagggctacaaggcgatcctgcacattggtgccagcgcccatcttggcagtgctgcctaagaggacgcgcacctgcccggtgcggaccttggagaacagttcctttttccgtacctctgtgttggcttcgtggataaaggcgatctggtcggcaggcatcccctgggcgatgagcttttggcggatgtcctcatagatggtaaaggcaggctccggctcatccagtgggattgcttcttccaacccatgaagcagcggattgtccagctgtttggctgcctttttgtagggggctgcctggggtgtggaaatgtcgcagaataccagctgggtcagcttatctgcgtccccgtcccgccagatctgcatgatgttgtccacgcactgattgaccttggtgccgggttcatccggcagtagctggttgatgatgcgctggtccagtcccagcttgcggccatccgaggtgattttgagcatattatccacggacgggtccacacttcctctgtgtacttcggaagcgcgctcggagagtgccttcaccatttcctgctgatgttcggtgggctgtgccacaatattgtggtattccacctccggggtgggcaggttcagctggtcggcggtcttgatgtccgccacctctttgaacaggttcatcagctctggcaggttgaaaaacttggagaatcgggtgcgcgcccgatagccggttccctccggggccagttccagcgccgtgacggtttctccgaaacggctggcccagcagtcgaaatgggtcatgttcagttcttgcaggcggtcatactggagataccgctgcatggtgtaaagctcggtcatggagttgctgaccggggttccggtggcaaagataacgccacggtttccggtaatctcgtccatatagcgacacttcgcaaacatatcgctggacttttgggcatcgctggtggagagacctgccacattccgcattttggtgtataaaaacaggtttttgtagttatgcgcttcatcgacgaataggcggtccacgcccagctgctcgaatgtcactacatcgtccttgcggctctcggcctgcaatttttccagcctggcttccagcgatttgcgggtgcgttccagctgcttgaccgtaaaacgctcaccgccgctggcctgtacctcggcaatcccctccgtgatttcatcaatctgctcatataggagccgttcctgacgctcccggctgatggggattttctcaaactgcgaatgtcccatgatgatagcgtcatagtcaccggtggcgatccgggcgcagaacttcttgcggttgtgggtctcaaagtcctttttcgtggtcacaaggatattggcggagggatagagccgcagaaactccgaagcccactgctcggtcaggtggttcggcacaacaaagagggatttctggcacagccccagacgcttactctccatggcggcagccaccatttcaaaggttttgccagcgcctacctcgtgcgccagcagcgtattgccgccgtacagcacatgagcgatagcgtttttctggtgttcccgcaaggtgatggccgggttcatgccgccgaaagtaatgtgtccgccgtcgtattcacggggacgggtggagttcatttcctcattgtactggcggaccagagcttggcggcggtccgggtctttccaaatccagtctttgaaagcgtcccggatcgcttgctgcttttgggcggccagggtggtctctttggcattcaacacccggcgctccctgccgtccgcgtcctccaccgtgtcgtagatacggacatcacgtaggttcaggctgtcctccagaatcttgtaggcgttggcgcggctggttccataggtggtataggccgccacattgttctggcttatggagcttttgccagtgatctgccactctgctgtaaatggggtgtagttgacctcaatattccgctgcatataaaacggggtatcaaaggtctcgtacataaactgctggatgtactctttgtcgatccatgttgcacccaggcgcacctcaatttccgaagcgtccaggtctttgggctgggcggcggtaagggcttccacattggcggcgaaggatgggtcctgctgtgcggcccgctgtgcctgacgcagcttgcggcgcacattgccggacaggtattcgtcagcggtcacataatggggtgtgccatctttctccacttgtcccggtacacggaagatcacgccttgcagctcggcagccagttcgtcgctggtcttaccggtcagctccgacatatatgccatatccacacaggctctctccgcgatggaaacggcaagggcttcactggcggtatccacggtttccaccgccttgtggggcttgatggtccgtttggtgaacatatctgccttgcgctccagcttgccgtcctcgtcaatgacttccagcgcgcagagcagatagtagctggaatcatcggcaaaggccagccggttcgcccggtcattgatcaggccatattttgcggaaaagctgtcatagagccggttcagttcggcctgtttatcccggatggcgctgtccggtgtggcagcgtccatttgcaggtcaatgagctgctggacacattctcgcagccccaccagcccttgcacgcgggcctcggcggtggcattcaggtctgggcgtaccatgcggctgttttcacggaaatacacatctccgtccaccacggtataggagtagtttttcacattggggtcggcggggatggaggtgtcgatggcttcgccctcacccagctccggcagatcggcttcctgataagtgccgcgaatgtgcttcaccgcatcgtgcagctgatcggcaagctccagtccctcgatgggattcacggtgtagtccataccatgggcggtgctttccggttcctgtcggcccagcaccatttccgggtggtccaggaaatagcggttgatggcaaaaccgtcctcggtctgtccggtctgcgtccattccggcacgatgtccagtggacggtcccgcttttgcaggaagatgatgtctgaaaccacctcggcaccggcgttctttttgaaagcgtcattgggcagacggatggctcccagcagctcagcacgctgggcaagataccggcgcacggtggaatctttggcgtccatcgtgtagcggctggtgacaaaggccaccacgcctccgggacgcacctggtcgagtgctttggcgaaaaagtagttgtgaatgctgaaattcagcttgtcataggctttgtcccgaacctgatactggccgaaaggcacattaccgatggcgaggtcatagaaatcccgcctgtcggtggtttcaaacccagccgcagtgatgtcggccttgggatagagctgttttgcaatccgtccgctgatggaatccagctccacgccatacagacgactgtttcgcattttctccggcagcataccgaagaagttgcccacaccgcaggacggctccagaatgttgccggtctcaaagcccatgcgccccaccgcttcatagatggcctggataaccgtagggctggtgtagtgggcgttcagggtggagcttctggcggcagcatattcctccggggtcagcagctctttcagctgggcatattccgcagcccatgcgggtttctccgggtcaaaggcatcagcaagaccgccccagcccacatagcgggaaaggatttcctgctgctccggcgttgcctgtccggtggtttcttccagatgtttcagcagtttgattgcttcgatattggcctggaacttggctttcggaccgccttcgcccaaatgtgcatcggtaatacggaagttctgtgcattgtggcgcaggttagccttgtattcctcataagaagcttcctcggcagctctggcattggggaaggtctgccactggccgtttaccggaatggaaaccgggtgttcgtccagcacttcctcaaaggttttctccggctctgtcacaggggctggtggctctggctcctcgatatgcagccgttccaccaccacatcataaggcagattgttcttgtcgccaggatagacggccacggtctcggaatggaaggccggggattcggcagacggttggggctgttcctgtccaaagccatccagctgacgggcatacatcccgcgcagcaaaggcgcaacctcatcccagcgaatatacagcacagccagacgcttttcctctgcgtccaggacttccagctccatgccctgtgccgtggtacggtaatcggcaatatcaccggtctccagatccagcgtctcgatctcacggggataggctctgctcagccagtaggcgatctcactgttgctcctgccggattgcagcagcgtggaaacctgttttttatctgcttcatccatcagtccatgggccaatacatcccgcaagtcctgatctgccttgtccgggtcaatgggaagaaactcggtatagtaagcattgcggcggtctgcccgaagcaactgctcgaactgttctttgcgctctgcccggtagatgggatataccatgccggtgggcagaagctgcacggtgtcatcccgcagctcggtgatctgataggcgtcatcctcgatatacacggtatctcccacggcatagaccggggtagcagggtcataggaggttctttgcggaatagggctgcgaacggcgtcatattcctcatcggaaatggaaacctcggaagtctgttctgcctcagcagctgcaatctgctctgcatccgacattactcgctggataaacgggtcattgtccagtttttccgggtctgccacctggccattgacgatccctctttcctccaaggcttcccggatggcgatagggtcgatgttgtcaaaacggtcctgttcttcttcggtatagaacctgtcctcctgaataagctgggcaagcctgcgctgtaccttgggccaaggcagctgcatttcctccgggctgccggcacggacaacaaacaggctgttactgccgccgtattcctgagccagccatgcggcggtgtctttctcccttgcatggtccttcatatagcggacaacggcgtgtttactctcgatattgccgttccatgcacaaagggcagaatcaatatcttcctgagagagaggacgcagcagctcatggagtttgggataggtttcgtctgccacttcccggtgcagccactggcgaaactccggcacatcagagaacaggcggatcagctctatatcgtgggaatcaagaatggtgcggcgcacagcagcattacactcgatcatagcgttttcataatcactatggccgcaggcgttgcggtatctggtgtcctgggtaacagcttccatcacgatgggcttgtatttctcatacagttcccgaatcgtaggggttgcctgttccggctccatatcccggaacactctggttccatctgcgccaaactctgcttcctgagcattgatgtgctgttctgcctcatggtcgatggagagcatggaatactcctgacgctctctgccgccctccgggacagcggaaatagttacatcatgctgatcccgcagatgttctacaacctgctccagccggtttgccggaaagccgcacatttccacacggccaccgccggggatagcgcgggtcgtgagatggaagtccagctccgcagcggcagttttggcatcttcaccatacagttcaaagaaatcgcccatctgatagagaactatgtcatccgagtgacgctccttgaccccgttgtattcccatatctccggggtcggctgctgggcttgcagggcatcttcttcggccagcgctttttctgcctggattttgtcatactgcgcctgttcctgttcagtgagatagcgtcccttttgaatcaggccggtaatccgtttggcaactttctcccatgtgaaatgcatatccgggcagccgtcttttttatagtgcagaccctttccatcgtgatcttcattactgcccatagcgccggacagggcgtgagagtgaccgccgatgccgtactcagatttcaggaaatccaccttttccttatccgtatggggatttttgaaaaaggtgaaaatgcggcccttgccgccctcgataccgctgccgccggtcatggctgcgtcgatctcgtcctctgtgatgaactgcttgaccgcaggaacatcttgcatttcagacgaaaaactcttgcggggcagggacaggtcttgcagactttcccaaatctctctcggtttgtggtaatggaaccgcagcaactcccgatcctgctggtaggccgtccagaaagcagcgtattcttccgcaagggtctggcggaactccgggctattcagctgttcagtaagccatgcggtttcttccgggaacccggtcctctgaataccggacagacaggacagatacccggaatctctggctttatcgctgaaatcgtggtacaaatgccaaagtttttccgcaaggagggagcgttcatagcctgccgcttctgcaagctccacattggaggcaaactggccactctccaaaagctccccgatacgctctgcggcgctctcccaggaaatgaccttggcagacctgtcataacggacagacttcccatgagaaagatggataccatcctcggcataccatgcgctcacgctgccaaggccattgccgccgtgatacagcgttttcagtatctcggcaatctcagcggtggttttctgcttttcaaaggctgcaaccacgcgctctctctggcggtctgtattgccgcccaaacgcagcacatggtcaatatcattttgggcaaaagaaaaagcagaggatgtatgcgctacattctctgcctcatctatagattggatctgttctgcttcggagaggaacaggtttagggtcagctgttgataagctccgccatcaggatctcctctgcctgtgctttgcaggtattcatcagccccacccacttcatgggatcgctggctttcagttgctcggtggctcccgcttctttcgccagctggggcatcatctgctccagtctgctctgggcggtctcgtcgatctccagaaggtgctggtacaacttctcgctcagcagcatctggttgtagaggatgggacggtgttctttcaggtaggttttcctcatcctgccgtacttgcccaggggtttctccggctgctggctcagcttcaggtcgggaatcagatagtctccgttctggatgtaggtcatgggattgttcatcttgcttactcctttcttggttggcttcgcgctctgcatttcggacggtaacgccgatctgccgcagcacctgctggttgatctggctgaccgctgttcccagcgccccgatggtggacggggtattgaaatcaaagatcgccatgaaatcttcgtggtcgaagtagcgttccggctccagtccgcagcgggacatcaatgcgtaagtgatgctgacggtggcggctgccttgaactgcactccgatgttatactcatcatattcctccaaaaaggaaccgtcaacgatgtagaagaagtcctgctgatgctccgtccagtattcctcagccagtttcccggctacctcggtaagttgtccggcaaggtcatcgccggaaacatcataggtacgctccagcatggcctgcacggaatcaagatggcgctcctccagctgccacagccaaggggtacgggaatgttcacgggttccggtgtcggaaatatcgaacacatagcgcaggcggggtctgtccccggaatcatccaccagagcgatccccttggaaccgcgccttacatatcggcccatcttttcattccacaggtcgtactctgcacaggcggtagcgtccgggcgttgggcatagatcagcagctgttcatggaatggatacttgtaaaggcgggcagcggtggtcagaaatcccgcccattcctgccagctgcctgtgagctgggttgccacatggtcggccatctgccggtaaaattctgttttggatggcatggtgttttgtcctcctttcagttttgggtaaaagaaaagcaggaaaccttgaaagatttcctgctgcttatacgtttattacctatttttttgccagaatacagatatgatgttttttgtttttatgatcgatggtgatttctgaaaatcctgcttcagttagaaaaaattctaactgctctacagtataaattttcatgttgtcaatgattttcaaccacttatcatccgctttatttgtaccatcggattcattcacaattaaaaaacagccaccttttttgaggattcggtacacctctttaaaactttcaagaggtcctggccagaaatatacggtttcaaatgctgtagccaaatcaaaagtgtctgcactaaaaggaagattcaaaacatttgcatgagtaacctgcaatcttccgtttttaatcgcttgctgattgaactgttttgttttttggacagaaacctcagagtaatctaaagcatgcaccgttgcagccggaaatcgctttaataattctgctgcatttcgcccacctccacaccccagatctatgattttagatgggtgcaattttgtaatatgctccatcccccaatccgaaacagcagcgtggcctttattcatacttttcaccataagttcgcccagcaagccttctggttttcttgtgctattaaataatttttttacaattcccatttcccatttccaacccgttcttgatatatttatatctttttcctgtattcgattcctaaaataaacaacccagtgataaatatgattaaaaaacaaccgatgggaacagcaataccatgttcaagcatggtacaaatcaatctgcccggtggtgttatccaactcgttacgggatttaagatacaagccaccagcagaataacaatgccaatcgttccactcaaagttaaaaaaccgccaattagtgtttttttcatagcatctacctctttttatatccgaagatattaccggttagcattaactaactataaatataccacaacagtcagtaattatcaagtatttgcttattcatcaaaatccgggtacagttccagctgggaaaactcggcgtcgctcatagcctggagcttcatcagggcgctgtccgtcagctcccgcagttccgtttcctccggcgaaagttcgccgcgcatctcggtcagagcctccatcagcccggtgcggctgccggtgttgtaaatgcacatcaggttcatttcctcaaaagtaaagtttcccatatcaaatctccctttccgcgctctttttgggcgctgcctttttgcgttccgtccggggctggcttttcagctgctccatgacggactttttcttgtcccgttcctctcgatgggcggcggcagccaaatccataagagaaataggctggccactgcgggcctgctgttccagctgcgccacggtccgctcttttgggccgttgttgatgatgccgtcaatcatgccgtagtcatcctccagcatcatttccgcatttttcagcggattgtccggcaggaatccgggaatctcggtgaaaccaacgctgtcgcagtaatgacaggataccttaccgtcctgcttgatggcaacgatgtcgctgacgctcatggacggactgtgaaaatccaccggtttttgcaggttgaactgctcatacagcgtttccagctgctccatggcgctgccggaaccgttcagcggggcggtgtagatcatgtcataattgtttcggtccacagccagattgtgcgattgcagccagtccagattcataaaccgcacattctgcggatcgtcccggctcacctgataaatggcaaagcagctgccctcatgggcaagaaatgcctgctctcgttccatctgccgttcctgtcgttccagcaccttttcatggaacgccggactttgctcccattcctcgtgttccacaccgaaaagcccgccatgctccatgatttcctcggtgtcaaacaccatgctctccgtgttatcttcatggagaagatagacggtcagaccggcagcgtccagttccagcgcccgttctctggtgacaggcagcatcccgtcatagagatagccgtattcctgcatatccgaaacagatacttcgctgtcgggcatggggtactcatccaaagactgctcctgagcatcgggcagctgggtggcggcagtttctgcggtctgctggctgacctgttcctgcatctgctgacaggctgcatcctgcaaggtctcaatcatagacagcggtgcatcctgaatcgacggattttccagttccagcccctcacaaatctgccggacagcggcggaacgggacagttccggttcatccagctggccgccgtccagttctttcatggtttccttgtcatagagggtatagtcccagccagtatcgcacggctgaatatgcagataggtggcatcgttcagaagaaacagggctttctgcggtatatccgcctgttccggctcctgtttggcggtcaggtcaatgccgcgctccttacagatttccttatagtggcgttcaatgtcgttaatcagctcacaggaagtcttgttgatggtctccagactggctcgcagctccttcagttccttgcccttggaccaggaagcgatgtaaccgaaactgttttccccggtctggatgccgaaatactggcagactgcataggaaatgctttctgcttcgacttcctctgtgcgacggtcttttttctgttcttgcaaaaactgcgagagggtaagcataccgccgttaaaattcagtccgttctcatctgtaaaatacagcctgccttcttctgaaaattctaacggagcagtcaaaataacagagccagcgtggttcaccaccactctttcctcaacacaaatcgggaaaccggggtcatcatccgaaccgcgcaggtcatagcaataaacgccttcgggcagatcatcatgggaaatacgcccattggaaaacagggcgggtttctcaaacaactccacctcctgatattgctggtcattgtcaatctgaatctttttctgattatggagcttgctgtgtgcgatttcatggacagcggcggaaacagtctgcacctcgctcatgccttcccggatggcgatgcgctggcgttcgggtgaaaaatagccgtccatgttgtccgccatcggctcaaactcgatgggaaccggggcagagcgccgcaccgcctccagaaacgcttcataatgcggcacagtccccgacaagctggatgccaactccggcagcggcttgccgtctgtctggctcacatcaaacaccttgaccgggcgaaacatggggatttcgatttcctttttctccatgaccgccttgccgtctgcatccagaatgggggcatgggtatccgggtcgcgcttcatttcctcgattttctttttgtagggcgtgggggcgatgatggtaatgccatgctcaccctttttcacatggcgctcaaactggtttttccacttgttgaacccggccaccaaagtggcatccggcttctgcatatagatgagcatggtgttgtttaccgaatagcggtggaagcgggacataacggacagatagcgcatatacttttcactctcgaacagttccttgatgccctgctcgatgccatctgtgatttcccttagccgctctcggttggtggatttattctcagccatgattttcagtctcctttccaaatgtgtgatttctgctgtgtgttctgtaatccatgccttttgttcttcttcattttcgtaaagaaaaaggtccagcaggtactctacataggttttcttctggatcgcttccacaaagagggggtgtggttcttcctccggtgtgtgaggagaataggcattctcccattttttcagcagatagtagtaatcggacagtatgcgataacaccgctgccggtcctcccgaaactgctgcgtctcggttttctggcgaacatagttcctccggggaggggcctgactgtcataaataaggccaaaatcctgcgccagcttctcggcggcttccttgggggacaggttgtagagccgggaagccaggtcgatcacatcgccggtggctccgcaaccgaagcagtagaaatattccttgttcaacttcatgctgggatttttgtcatcgtgaaaggggcagcagaccatgccgccccttttgacctcaatcccatatcgttctgcggcctcccgaatggtgatagactgcttgaccgtttcaaaaagattgtccatatttactcactgtcagcttttctaacaggcggtctgtacccggcagccttggcccgttcactggcagccttgcggcgctcggcactgtatggctcccggacggacacacagcgtttggggaccgtaaaattgtgcttatcttttttacagacctgttccgggtgttttttggaaaggctggtcagcttctccatcagtttccggtcatgggtataaacttcggcggtgtcctcggcctggttgtagaggaggatggtttcctgttcgtagagggaaagtttcatcgtttgccgcctttctgccggtcaaactccagcttgaaacccacatacttcccatcgtccaccagaaccaccgttgcgtcgtaggtcttgccggttttttccgaatacaagccgctcacatgagcgcgtccctctttgagcagcgctgtcacaatagccttggtaggctgattacgcttcatttcccaccacttgttgtttttccagatggcaaatttacaggattctgtctggcagaagaaccctttttgcagttccgccacatcaccgccgcagcgagggcatttgcccaccacttcgcggggcggcgtgaacaggtactcagtccccttgatgacctgataggttcctaccaactcccggagcatggcgcagatcccgcccatgaagtcctccggggacagctcgccgcgctcgatctcgcttaaacggtgttcccattcagcggtcagcaggggcgattgcagctgttccggcagaacggtaatcagggacaccgcatctttggatggcatgagctgcacagctttcttactcttttttcgctccaaaaagccggtggacaccagcttttccaggataccggcgcgggtggccggggtccccagacccttgcgctcggcatcgtccggcatttcctttgatccggcagtttccatcgcggaaagcagcgtatcttcggtgaagtgtttgggcgggctggttttgccctccttaacggcagagctggaaaggggcagcgtctgaccctcggacagttctggcagacggcctccgtccggcagggccttgtcctcggtttccttgtccggctccgcatttttcagcccagcgcggtaggcagcgtccagcgcccgccagccggggcgcttcaccgttttgcccttggtggtaaactccgcaccggcacactccacggtgacagcagtttctgagtaagtatgcggttccgccaccgcgcacagcaggcgcaaagctacaagttccaaaatcatccgttcacccaccggcaggccggacaggtctgcgccatgaagattgcgggtaggaatcaccgcatggtggtcggtcactttcttatcgttgatgaccagagcctcatcgcaggaaatggcgatccctttgcgaaacggcatggcgttggcaaccagattgaccagcaccggcaatccctccgccatatccgaagtcagatagcggctatccgtgcggggataggtgcagagcttcttttcatacagattttgcagataatcaagcgtttgctgggccgtatatcccaacaatcggttggcgtcccgttggagggtagtcaagtcatagagggcgggcggcttctcggttttgtccttgcgctccacctttttcactgtcacatccgcaccctgacaggcagttttcagctgctcggcggcagccttatccgccatgcgttccccggaaacggaaaactcaggtagctccaggactatcgtgtaaaacggaaccggcttgaaggtgtcgatctcggcttcccgttggacgatgagggccagcgtcggggacatgacgcgcccaatattcaaagtgcggtggtacagcacggaaaacagtcttgtggcgttgatacccaccagccaatccgccttggcgcggcagagggccgcctgatgcagaccgtcatagtccgcaccggggcgcagatttgcaaagccctcccttatggcggagtcctccatcgaagaaatccacaggcgtttcatgggcttttggcagcctgccagctcatagacgctgcggaaaatcagttcgccctcgcgtccggcatcacaggcatttaccacctcggtcacatccggggcgttcatcagctttttgagaacatcaaactgtttctttttatctttgtccaccaccatctgccaatgttccggcagaatcggcaggtcatcatatcgccacttggcgtacttggggtcatagctgtctgcatccgcaagaccggccagatgtcccacgcaccagctgacacgccagccgttgccctccagatagccgtctttgcggacagtcgcgccgatcacggcagccaaactctgggcaaccgacggcttttcagcgattaccagtttacatcccatcatcttcatcctcccattcttcccgcacagatgtgtgcagttttttctcaatgctgttttcctcatccagcagcaggtcatagccgaaccggtagtcatagcggtacagtttccccagcagatcgttgataaggatacggcaggccagaatgacacgggttttgtccacctgcatcaaccggtagcgttgataattgctgtaatattcctcatggcggcaggtacggcggacggtttcctcaaacaaaatatccaccgggtcctggcagccgtcctctttttcacattccatacagttcagaagttccatcaccataggaaagctccgttcatccattggggcttcttctgccagaaaacctaccagtgcagacaaaagcaggcgggcggctgtctgttcccggtctgtcaaaaccgccattgtctgtgcggcattcggcaggagcctttcttccacaaaatccgccgcgtctcctgaataaagctgacggatggaatctatggacaggggaaccgctgcggcatccagggagaaatcaaaaggttcctcccgtctgggctttttccgaaatttgctccacacagttgagagaatgtcgcggccaaaatacgcggcgatcaccagcaggtcaaaaaccgcaagcagcttgataaatgtaatcagaatactcattttttccgtttcctttctttgagccagcgttccatctcacggtggcaaatgcccacgcagggacttccataattcccgcagccataacaggggtggctttggggcaaagagggaggacgggaagtttccttcccgccctccggcctgcgtgtcatcattcgttcatagggactgtctgtgaaacgagtcatttcacgctgtcctcgtcatcttcttctgcgctgcccccgtcagcgtccggctcgcccgattcctcgtcctccaattcgatttcttcctcatccggcagttcctcgccgtcctcatagtcataatcgtctggattgctgctgtttttgtggttggccttacccttaatgaatttgaaataggtaaaggcagcgccgcccatcacagccagcaccagcagcaggacaaccgggtttagtcctgcggattcttttttctcaggctccgcaggttccgcaggcgtttccggctccgcttccttgccggtacaaccggtcatgtccgtactgcacacctcgcatttggtgttgaccgcaccggcttcgcatttttctgtgcagttgcagacaacgggtggtttctcggcggactgcccatcctccatcagcgccatcaggtcagcttcatccacctgatttaagaaatggacggcggtttccttgtcctcgttggcccggtcaatgaggatgtaaaagtagttgcccgccttggtggtgacggtaatcagctgcttgttgccgccgaaatcatctaccagcgccgcgttgccctccggggtcagggcaggactgtcctcggttttttccaccaccacattttcatcgttggtggcatcctctgccgggggctgctccgttccctgggcaaaggcggtcacggaaaggcccatcatcagcaccagggcggcgcagagggccgaaaaggtcttgaaaattctcttattcttcatgggcggtgtcctcctgttcgttgtagtcggcggaggcagcggccatgccggggaccgtaccgccggagagcatagcgttcagctgctccggggtcagccgcagggcgcgcaccatctggacgatctccagattttccgcttcggttttctgcgcttccagcgttttcagcttttcctgatactctgcgattttctcacgggttttcgtaatttcccggtcaatgcgttcaattttcgtagccataatcaatcactcctatcaaaagatttgtcaccagttcatcaggccgtagcccttgatgcactcatagttcacatcgtagcttctgattttgcaggcatcgccgctgtttccctctacggtataaacgcggctgccgtctgtgccgatgacgatgcccacatggtcggcgctgccgtccaggtcccaatcgaagaagatggcatcgccgggggcgaggttgtcatagccccgcgcgccccattgcccatgtgactggaaccagggtacaccctgggattgacagcccgcaaagcgcggttcagacagccccatctggccgtagcaccaggacacgaagcaggcgcaccattccacgcgggaattgaatccgtaccagctccagtagggctgaccgcccacatttcctacctgacgtttggccagttccaccagctccgggttgccggggcgtgtgccgtttacaaactccacaccctccaaactctcggaatcactggtattcgtggaaccgccgccgaagatcagcggcttgttgcccagtgtctgccggtacacctgatacatctctagctgttccggggtcagcagctccgaagccacagaggatataggcttgctggtgagcttcacattgaggatgtagtagttgtagggaacctcaacggtatagctgttgccctcgctgtccgttcgggtttccgtccggtagcgcacctcgacttcctcggtgagcgtaagctgatactgtgcatcaaacacacgctccagctccgcctgtgcgctctggcgagtatagccctgcaacacagcagacagataagccgccaactcatgggggtcatgcccgatcatatccaggtcataacggtattcgtcatatcccggatggctgatctcaatgttgtcgatctcagcttgcagcgccgcttccttggcggcgtaatcggcctccaccgccaccagctccaggtcatccgacggataggtagagccggaaatggcagaaccaatgctctgcgccatcatggagcaggaggacatggtgttgagcagcaggcagatgagcagaaaaatcgcgcccacaagcaaaaagccttttttgtggcgcataacaaatgctccggcctgctgtgccttttccttgaccgtcttggcggccttgccggtcttttttgcggtgttggcggtgtttccggcagcttgaccggcgcgcttggcggcggcgtattcctttttgatggcctgcttctgctgccagcgtgaaaacggattactggtaagctggggattttcccgcagggacttttgatacagggcgtttacattggccttttccagcttttgttccgcctgtgccgccttgcggtatggcttcagcttgtggctgcggtagccttcccggaccagccgcgcaccggtttcaacagcttcctcggacttgtgggcgctctccacgcccacattgtcctgttccgtttcacggatttccttgtggagtttccccagcgccgcatctcccggagcatcccggaccgcatgggacagcttggagggcggctttttcttgtcctccagcaccagtttggtagtcactttgccggtccccaggtccaccgctttttgccgcacctgctttttcgggattttcgcctgcgccttgtctgctttgacggcggcccggtctactttacggatgggcttctccagcgccgggtcagcccgttcctcgtctgtaaagcgcaggcgcggttccttacgcataccagccacccgccatcaggtcatccagcagcacacaggtttccgcatataccggaatctgaatggtttctgccggaaagaccgttgtggacaggaaaagcgccatcagggttcctcttgccatgtcccgatcctgaatcgggctgcccataaacagcttgggaacatccggtatgccctctgtccagatatggtgaatccgggtaaatccggcatagcccttgggcgtgagattttttgctgtcttttcctgctcatagcagtaatggacggcggcgcgaagcagttccaccatctgctcacatccgctgacagcggccagaagcagacctgcgcctttttcaatttctttctttgtcatgctgttcatcctccttttttaagtccaacggcttggtggtcatgatacggtacagttccgtattcttggggaagtggtccacaaaaggcaggatggtggagccgtagaacaaaagtccctcgccctcgccggagtgggtcacataggatagctggtgcggggaaatgcccagctgtttggcaagaatctgccggtctccgcccgcctggttgagcatatacacgaagtcggagttttcaaagatgttctcaacctcgcggctgctcaaaaggtcgtagggtagggtaaaggcgccttgccgccgctggcggtaggtttcctacaccctccctcggaaccggacttactcctctcaaagtatccggctccccattagtaattgacgtattgattagtgtctgtgtattctttcatggcacttgctgcaaacgacaagcgtttttctccgcttctttttcatcacggtttcccaatcagaattacccaattcgtttaagttccgtataacgtgaacctcatacaaatcggcttctttacacccacataattcacaaactctggcattgagccgctgtctgatagtggttttccagctaaatttctttctctgatagatgatgtcactcgcttcgccacgcttacagtcagcgattttaacggggcgcacacgctttgtccctgttttggtttcataaggaacagaccatgttttcccgtctttatactggcgaatgattttgcggatactggttttatgcttattagcaatcgtttttaagcaactgtactccatgagatagcagaagtagtccaacgtgtgataatcacaagccagattgtaatagttgcataaccctcttgcttcggcattgtactgttccacaatttcataatccgcaaggttgagaagtccggctcggtgtatcggctgaaactccccgttttccttttggcgaatgactttctttgcaaacatgaatttttcaatcttttccgtatggggaatagacaaggcaactttcatgtgcagggtacgggattttctccacgttccgtttttcattctgtgacctttgacttcctgatttctgcggacacaaatatcatagccaatgaagcggactttttcggagctgtgcgttatcagcgtcttttcctcgctcagagttaatttcagctctgtgcttagaaattcagcgatttcggctttcaattcctcacattccgtttttgtgccacacacgcctgccagccaatcgtccgcataacggacaaaagtaaacttcttgttgtcggcaggtttgcagggcagatttctcatagctttcttctgcgccctatgctggtcaatcagttcttgtcttgccgcttcatcagaggtatggtcaatccagtaagacagtctttttaattctttgcttgccgcatgatattccagtgtctgatatgcagacctcggcttatcaaagagttctgcgatttcccgaaacttcttgtccagctcattcagatagatatttgcaagtatcggggaacagataccaccctgcggagaaccgctgtaagtggcgttgtacttccaattctcgatatacccagctttcaaaaactggcgaatgatgttcagaaaacgactgtccttgattttcctgctcaaaatctcaatcaatttttcgtgattgatgttatcaaaacaaccttgtatatcgccctcgataaaccagaccacgcctgtgaagtcagaagaaatctgacgcagtgcggtatgacagcttttgcccggtctgaaaccgtgggaatgactgtcaaagacaggttcatagatagcttccaaaatcattctgacaacttcttgcaggagcttgtcacggaaagacgggatacccagcggacggagttttccatttttctttggaatatactcacgccttacaggattagccttgtaggttccgtcctttagtgactggattaactcttttatatagaagtcactgaaaccgtctgcggtatcgtcgtcgataccctgtgttgttgcacctttgtttgcataaagtttctgataggcggcgtagtaaatatcttcacgaagcaagtatctgtaaagtcttgtgaatacgccgtctttgtgttcgctggaacacttttcaatacgctctaaaatttcagatgttggtttcattgaggtttctcctccctttcattcttacattttagatgttactaactggctcccttcgccatgtaagggtcattacccctctcggactactatggagcctccgttaccatatccggcaaatgagccggacttaggcaatccccagttagcactgtgcataggttagtgaagattgtcggatatgctttcggttcgttgtgacgtgttctcacgcctgtttcataacgtgttggcagttatcccgccgtgaaagatgacgtgacagcgttatgacatgggtttcaggacttttcccacacctgcaaaaaacaggaactggaaccttacattcgataaacccaatcttatcctcatatcttcttaacattaggaaacagtcgcacctaagtcctttggtgactattcctttttctgccatgcgctgttcccgtaaaggatttctccttagtcggtaaggcagattgtttcgcacactgccgtgtgcggcagtaccttagactgctttgcacagcgccctatctgggcgcactttgacattctgtgtgataccagtcgggatgccgccccacttgcggaaccgcttccagatttccactgtataggcggcggtctgttcctctttcagcagcaggtgcatctcgtcgatgtagtaacgggtggacttgtgggcggcgcggttgatggtgacgcggttccacacctgatcctgcaccaccagcatcccgattttcttcagctgcttgcccagttccttaatgtcatagcagacaatacggttgttgatgtccacattggttcggtggttgaacacattgagggagccggtcacatagatttccagcgctgtggcgatgtactgtgcctctttttcctcctgcgcccgcaagagattatacaaatcctccagaatgggcatattctccgggcgcggatcgttgagatagtcctgatagaccagccgcacacagcggtcgatgatggttttctgcaccggctgcaagccctccttgccgcccacgatcagctcgcacaggctgagaatgaagtcggatttgagggacagcgggctttcatcatccgaatagtccaggttcaggtccatggggttgatgtagttggtggaagtgggcgaaattttgataacctgcccatgcagacgctccaccagcggggcatattccgcttccggatccaggatttccacctcgtcggaagtcagcaggaagcagttggcgatctcgcgcttggcgctgaaggacttgccggaacccggcgtaccgagaatcaggccgttggggtttttcagcagcttgcggtccaccatgataaggttgttggacagggcgttgatgccgtagtacagcgcctctttaccgttctggaataattcctgtgtggtgaacggcacaaagatagccgtggaactggtggtcagcccccgctgaatttcgatctgattgagacccaaaggcaggcagctcatcagcccttcttcctgctggaagtccagccttgtcagccggcagttgtatttctgcgcgatggagcttgcctggaacacattgttgtccagctggcgggggttatccgccgtgttcagcaccaggaaggtaacaaggaacattcgctcgttgcggctctgcaaatcctgcaagagctttttggcctcaacaccataagtggcaaggtcggagggaatgatgtctatgtcgtacccggcacggacagcctttttctgttcctcgattttggatttatccagatcggtgatttttcgtttgaccgtcttgatggccttgatctgatccactgactggatgtgcaggctgacaatcaggttggattccatatccagaaaatcggccagcatccggtcattcagctctggggccaaaatttgtacgaagctgacggctccgtacttcttgcccatgcggaactgcttgccggtgcggaactcaaaggagctgggggcgataaagtccttggtggacaggccgctggaggggagccagtcccactcaaaccggaacggcagctgctcgtccatgtggaagataccatgcagttgggcaagccgcgcctttccgtccagcgtttccgccgccacgcccagccgcttgaagttattgagaatgtcggtctcaatgcgctccagacggggcttggccgccttgatgctgtccgcgtcaatgccaaaggtgagatacttggttttgatcaggccgttatttccctttgccagctggttttgcagcatggtcatgtattcgatgcggatgctgtcaaaatcgtccccctggagagggatgttgatggcgcgggcaaaggtttcctccgatgctgcaaggttcaaaaaagacagctcaaactgaatcgagctgtcgaagtagttgaggaaatcgcaccagccctcgaaaatcgcggttttatcctcgttctgtgagagctgatagttgatgtcctgaaattgaatggtttttgtgtagtgaccgtctgatacccggcagataccgtccggccacattcgttcataagggatactgtcctgtgccgatttttcctttttgtccgtgcggtttgcgcgggcaatcgcagcttcaatctgctttctgtcggcgcgggacagctttttctttgttttgaccggctgcacagctttttcctcgttttttccgaacagccggtgcagccagcgtttgattgccgtaaacaatgtgtgacacctcctcgtcgagatttgcctgccgctgcagcacggcatagaagttattggtgcggtaggggcgctgcctggggcggatcaccgtgacgcggatgatattgcccacgatcttttccaacggctgaccatgcttttcgtacatcgccagcaggaagaaaggcagcatcacgaacatcatgcacagggctgccgtactgttcccggcagagccacggagcagaaagaacagcggtacgcccaaaagcgcccctccgccgaagcagactaactgccgcttggttaagttgaaagcaaccttggttttgactttcgtcaggtctttgggtacaggtacataggccatagaaactccctcctccttaatgagcctggaatacagcttttgcaaggcttccggtcttaaagagggtaaagcacagtaaaaccgtatagcccacacagctccaaatcgccataatcacatcttcctcggtagcgatgccctgcaccagtacagcataaatcgccacacagacaatgataagaaatgcctggaatcccagcgccagcagggagcgcagatagttctggcccatgccgccccattccttgcccatcatggcagccatggggatgggcgcaacggatgtcacaaggtaaatttctatcatacggccataaatcacgatgaaaatgcagatatacagcgcccacatggtaacgccgataaacatactctggaaccaaagcccgaacagcggacccaaatccatttccatcagccggggttccatgtccgtaaggacagaggaaatatcaatggcggcatccgaagaaatgatcccggatgcctgtgccaccacgctctgcgccatatcgaacacgcccatgacgatattccatgtattcgtgacaaggagtatggctgcggctgacttgaacacccacttgaaaatcatccaggtatccacatcatgcaggttgtttttatcggtaatcatctggattagttccagcgtcattacaatcgccagaatcacaccggcgatgggaaccataatggagttggagaggttctggatcatgttgaaaataccgccgttccagccctgcggtgtttgcccaacctgcacggatatatctccgacctgctggtttacagaatcgaacatcccggacaggtttcccataatgccgcctaccagcatttccttgagccactcagtaagcgcgtccagcagaaaatccatacagtgcgacctcctttcagcccctcccgattattacgggaggggcaaggattttccagggacagtttagacggtaaacagaccggagagcaggggtacgaggaccatgccgaccacggcgacgccagcgccagccatgagctgttttatccctaattaggagtaaaaccttgctcgatggcgggcggcggcgtgtcaaaaaatatatggaattgttttagaaccgccccagcgggaacaggtcagcccttgacctgttccacctccgggatgggtttgagattgaagtgaatttcgatagaaatgtgtcgtgtcttatcgctgtcgatgtgttcatggacaacgatttctttaatcaggcggtttaaggtggctgcgtccagctccgtgatgtcggcatattcctgaatggcgtccacccattgtttggcgtccatcgccagccgcatttcatcagccagcttcttgcgcccctgtgcaacccgttctttcaactcggcctgttctttctgcgtcttgtccagcatgagattgaagttggcttcgctgatccgtccggcaaccatgtcctcatagagccgcagcaccatcttttccagaacctcaatccgttcctcgtcttttgtcagggaacgctccaacgcttcccgctggcctttctgctcggcttcacaggtgttggtcagcttcccggcaatggcttccccatcggtcagggcagccttggcgcactcccggattttgttcagaacaaggtggtaaagggtgtcgtactccacccggtgctgggtgcaatggttcttgccgaacgccccataggtcttacaggcgtaaatctgctgcgggtgcttggcgtgggtggtgcggatggtcagcgacttgccgcactcgccgcacttgataagcccggcaaacaggctggtttccccattctgccgagggcactggcgggatttcagcttgtcttgtacgatggcaaaacttttgctgtcaatcaacggttcgtgccgttcctccaccacaatccagtcctgcggcttcttctcgccaatggtgccgattttgaagcggtagtccttcttttgggaagctatcgccccggtataaacgggattcatcaggatgtcctttatcacggagaaatcccacatataccgcccgttttccgggtctttcttttcccatttggtgcggacattgcggaagccccgttcccggttccaccatgtagggcaaggcaccttctgttcctccagcctgcgccggatgaagttggggccgtgtccttccaacgcccaaaggaagatttgccggacaatgggggcggtttcctcgtccaccaacaggtggtttttgtcctccgggtctttccgatacccaaagggagccacacagccggtaaactggccttgctgggctttcagaagatacgaggaatgtaccttcttggaaatgtccttgctgtacatctcgttcaggatgttcttgaacggcgcaatgtcgttgctgtcccgcatggtgtcaataccgtcattcatggcgatatagcggacgttgtggcgggggaagaagtcctcgatcagtgtgccggtctgcaagtaatttcgacccaacctcgataaatctttcgttatcacaagatttatctgcctgcgctcgatggcctttaacattcgtttcaggtcggggcgctccatgttcagccccgtgtagccatcgtcctgatagactgccacaacctcccatccctgcttttcgcagtagctttccagcatatcccgctggttggcaatactggcgctctccccgtcaaggtcatcgtctttggaaagcctgcaatagatggccgcccggaagctgcccgccagaattgcgtccatgcctgtatattcgtatccgttcatcataaccgtttacccgcacaatccagacggaacacggttcttctgaacctcgtctttattatatcgcaaatcttgtgttttcgcaagattttccttgccggtattctgcccatatttttgggcaatcaggcttacaaagacatccgctgcgtccagctcgccgtcaaaaactgtggtaacatgaatctctgttttcgtttttgccataggcagttatcctccataatagaatagccagacaaggagaaggtcggcaacgaagtccggcaacgggcttcaaaaaacctcaaaaccatctctgtctggcggtttggttacaatttatattttcttttatttttctgttgctttggttgctgataggggaaaaagcccgcagttacggggctttccccggcaaccagcccggcaacgggagtgcaacaaagtcggcaacggggttggattttcagaaaggaagctccatctgctctgtgacctccacaaatccctccgggattttttcggctccgccctcggtattcgttgccggggcttcacgctcccagcccttttgcctgccgtattccgggaacatccggggattggaaaagtagtgccagcctgtgacacagtggttcataatgtcgttgacctcccggatttcccattgcttcggctcgtcaaaagggtggttcagggcttcccggaaaagctgcttggaacacaccatgctgccggtatagcggtcaaggtaggcttggatcatcccggccttggtatcctccggcataaaatcccgctggtgttctttgagatagcgtaccatttcggggctgaaagacagcttaaaatccccgctgcggtaaatggtcatggcttccgcccatagctgctcaatgtaggctctggaagcggcttcatcatccaaaatgtgaacttccgcctgttccgggtacaccatgaccggcagaaagcgccggttgccggatcggtcaaggggcaggaagtcaagggcattggaagtgccgccgaacacgcattgccgcagcctgtcctccgggtgggtttcgtatgggattttatagacctccttctgtcggctcaaaaaagacttgatttcctcaatgctcttggcgtttgcggtggcaatcatctccgacatctcaataatccagtggccttgcagtttgcggtacacattgtcatcgtccagcttgcgaaggtcatcggaaaaccactcgtctttcacggccagcagccggaaaaaggtggatttcccggctccctgaccgcccaccagacagagcatgacctcaaatttgcagccgggatgaaacgcccggtggatggctcccagtaggaacagccgcagggcttcataggtgtactggtcgctgtcggctcctaaaaagtggtgcagacaggtacggatacgctcggttccgtcccatgaaaggccgttcaggtagtcccggatggggtgatagccgttttcattggcagcgatcccgatggcggctgcaatcttcttttcgctggtcagcccataggtttcttccagatacaggagcagataattcatatccgtgtccgtgatggcggtgccggtacggtggtagccgatgggcttaatgatgtcggtacgctcggtcagcagatttttggcgattgctccggaaagcagtgggtcattctgaaagacggtcaggcagttgcggatactgttacggatgccgcctttctcggtgctttccagcatggccttaacttcctcaacgctccggggcggcggtgcttcttgtatggtctgttctgcggcctgccgtatcttcggcggcaagctctgccattcgtctttcaagattgctcacttcctttccacagtcgatgataagggctgcccgttcctccatgtccggggagagcagcacatccagcagatagtccacatagtcctgcttttgcagggcttccacaaataaagggtggaaatcctcgtctggcgtcttgggggcatagtcccgtttccagcggcacagcaggtttcggtaatcacacagcacccggaagcagtaacgctccatacggcggaaccgctgttccggggtttcctgccggggcttcctctggcttctgtgggatagctccttgtcctcataggggacggaaaacgcctgtgccagcatgagggcggcttcctttgggctgacagcttccagacgggaaacaaagtcgatcacatccccgtctgcctgacagccgaaacagtgaaagcgccggtcaaccttcatacttgggtttttgtcggcatgaaagggacagacgcacatcccgttccgtcccacccggattccgaaatgctcagcagcctgccgggtggtaacagactgcttgacagcttcaaatacattcaactaaatcctcctgaaaataagaaaagcgcctgtcattctcgaaaagaaaatggcaagcgcctgttagagttccatatcctgttttttctctgtgtggggctgctggcgtttctcggcctgttcctcccggatacgctgtgcccggcctttgactgcctgctggatggatggtttcttgcccggctcggcagtctggcggtactgctcggacggaagcacctgattaagccagtggcgcacatcccggagaatcttcacatcctcctgcaccgctgacaggcgttccctgtactcggccacctctccggcaagctgcgtccgttcttcgttcagctttttggtgctgtacttggttccctccaaatgcaccttgaaatagcggacagcggcattgtaggcgtccagctcgtcccgatgggcggcggcaaactgttcctttggtttcttaaaccggatagcggcatattccgcatgaaccggcttgtgagcttcaaagttagcgatatgggaaagcatggtgtcaatctccttcatacgcttttccttcggcttcatctctgcccggatggaaacggcctgctcactgacggtatccagataggtgtcaaggctctccacggtggacagctccttttcccgcagatagcggatggcgtccataaccttgttgaagtcgttcacagtgcctttgagctggcctttgctcgtccagccggtgcgctcctcccggcgcaaatccagatatttgcccagcagctccggtagggtgggttccttcgcttcctgcaaggcttccagcagggcggcctttttctccttcaggtctgcaatccagcctttcaggtggcgcaccatctggcggattgactgcatgagccggttggcagcggtaatgtcccggttcaggttgccgatgttggtctgtatccctcgtttttccatctggctgaccgctggccccatgtggacggtggggattttatcaagcccctgccgctcataggaacgaaggtcgaggcgttctgggcggtcattggcttccagatagcggttggcggcagccgcccagccctgccgccacatctcgccgtacttctggtcgttccagtctacagtgtcctccttgtggcttttccagttcccggacgggagccggatacgctcgccgttctcgtcaaggtcataaaccttccggctcttggaaagccatttcccggtttcgtccattgcccgcatggtcagcaggatgtgggcgtggggattcccatcctccttatcgtgaatggcaaaatcggcaatcatgcctttggaaacgaaaaactcccggcaatagtcccggagcaggtcggcgtgctgctccgggggaatttccctcggtatggcaagcacgattctccgggcaagctgggagttccattgtttctcaatcgcttcggcggcgttccacaaggtattgcggtctgcgtactccggcggggcatggggcggcagcatgatttctgtatggacgatccctcgtttctcggcatagtatttctgcttctggtcgtactcggaaaacagccgttcgccgctctggtaagctgcggcggctacggctgactggcggttgctgcgctggacgatctttatatcatggtggggacagggcataacggcttcctccttcctgtggctgattggatggggtggtggtttgccacctcattttgggcaaaagaaaagcaggaaaccgtttctgatttcctgctcggtggtgccgccggtgggcggctggtattcagttttgaaagttcgggtcaggttggcccgatgatggagagattggcaaactggaatttgtaaactaattagtacaaatcacctttgaagattcatcattcacaataattgcctgatgattgctaattgggcaaatgttcaaatctgaaaactcagctaatatcttttcagtaactttcttaaatggtgcggtaagataatgtgggaggatataataatcaacaaaactgagtcccttatcatcttcttgtgaataatcttctggtttcttatccatttgttcaatatatgtaattgtaggagaacatataattgccccagccgactcaccaatcatcagttttccattcataatttctttcttcagcaactcatcaatacccgtttttcgtaattggtcaatcagaaaaaatgaattaccaccagtaaaataaataacatccgcttcttcaaaagcagattttatcgtcaaatactcctcctttgaaatatccatttctgttaagattgctcctaatttcttgaataatttcctggcagaattcacataacccgtataaccttcgtgaattgaagctgtcggaacaaatacgaccttcttattttcaacttcttcttttatcagatttcctacacttgaaaagtgtgaacataaaaataatttcatttgtaatctcctttataaattctgatttgtcattgctttcattatacttcatcaagccgggtaagtataggatgattttgtaaacttgtcggacgggaacagcctaccccgcaaggtgttcccgggcggcaagtccacaaaggggtagctggcggcagccagcgcaggggaagcgtagcgtcccctgtgatgattggaagcagccgcaagtgtgctggcaatcatccgctttccgcaggaagcccccggcagggcgcaacgcaccggcttgaccggtgtatagttgcgcccttactccgtaaggggttccccggctaccctccgtttcacgctttccgcaacagtttccttcatgccagtttgggaaaatgcctgtttcagaatgtccatcacatcatcgtccgtcagcacttccggccttatcagaaaactttccagcatagcccctctggtgcagagccggtgcgtccgttccttccgggtaagctgcttcatttggtgttccagtatcttttcttcgtgctgcgcccgtcgcagtctggcttcgcctttggcaagctcccagttgagcttttccagcttttcattcatcacggcagccctccttcttggggagcagcgtgtaaatgcggttcggttctcccacaccccggcgcacccgcaggatcagtccggcgtcctccaattctttcaaggaacgcttgacggttacggagcttcgggacaaggccgccgccagctccacaatggggaaacggacaaacagtatcccgttggtatcctccgtacccaccgtaagggtggcgtccagcaggcgggcatacatgacctttgcggtgctgctgaccggcagccgcaacatggcggggggaagtggcatacagggcggcagaacggtgtctgcggtcataaattcaaaatccatttaagtgattttctcctttcgcttggctcgtttggacaggtaatgggggcagtcgatcacaacagcccggaagctctgtttgcactcatgctgacacttccggcacaggtcgttgtaggccacacgcccccggtcattgaggaagaaggacagctccaacttccgttttttgctcattctcggcatggtgcctcctatcatagaaaatccgcccatttcagccgtaacggtggagatgggcggatagcggtttttggtgtcatgtttcggggcgattttcaagaaaaatacggccatagagccgcttggaaaagccccatagtatcacggacagggcagactacgccctgccgatttgtcgtgtttgggtagcgttttggtgtcagttctgccgggtttccctgatgtcgttcctgcccctgaatctcacagcagcgtttcgttcccgttggtacgctcgctgcggtcaaggttcctccaactccttgccgcaggtcgttgcactacatcgccagggagcatatcccatcaggccggtcattcgattggaataatccatcgatgaactgacttaatcatagctcatttttgaaccctttcccgtatgtccagaaagtaggaataccgccccaaaatcgaaaatttccacgatttcggaacggtatggtataatgactatatatgctcgaaaaccacatgggaagggagtggcaaaccgatgaaagaccatgtttccttacaggaacgcttgaaagatttacgggtggaaaagggtttgaaactggaagaactggcggaaaagaccggcatttcaaaatctgctttagccagctatgaaaatgaagaaaaccgaaataaggaaatcaaccacggcaaccttatcacactggcagacttttatgaggtgtccatcgactatctgttctgccggacggaaaaccgggagcagatcaacaccccgctgtccgaactgcatttgaccgatgaagccgtggcgcttctgaaaagcggacggatcaatacccggctgttgtgcgagatgatgtcccacgaaaaatttacagagctgatggctgacgcagaaatctatgtggacggaatggccaccatgcggttccatgacatcaacagtgcgctggccgctgtccgggcaatgatactggaagaacatcccgaagctgccgcagaccgttccctgaaaattctggaagccggtcagatagaggaagaagattttttctgccatgtgacacacaaaacatgggacgctatccttcacgatatacgcaaagcccatgagaacgacatggagagtgcgccggataccacgcccgccgatgaactgataaaggaagtccgaaaggccatgcaatccaccggcgacagggtgcaggaatttctggaaatcttctgcaaggcgttccagctaaaatacaagcggctcacagacgaagaaagaacaaccctgaaaaagctgttcaaaagatcgccgctgattaaaaattccggaatcaacttccggcgcagaccgtggaaatgaaaacagccgttgcgggatcggctcctgcaacggcagctttgaatcatacatgaatttggaaatcccgaaactcaaacaatccatttccctgtttgagttttccagctctcgataattttgcaaatccggcttcaatgtcagctatcaaagaaacaggaatatccaactggtggtgtccgggcagaactttttttattttgtatttctgtatccgccttatggattgatagaataactgcgggtcggtagttgggtaaaatgcatcaaggcttcccttgtatatcaaatccccggaatacaaatagtttcgttttggttcgtaaaaacaacaatgtcccggagaatgtcccggcgtgtgaataacctgaatttctcgctcgcctaaatttaaaaaatcgccatcatgtaagattctttgtggcataccttgaaaaatctgataagcgttaatatcaaaatcttttgggaaatcacaaggaagccttgtcaaattattcttcacaacttgcaacggtatcggaaacctgactgataaccagtccttttcctcttcatgtacggcgatattatcaaaatacttatgcccgccaatgtgatcccaatgaacatgagtagtaactgccataacaggcagctctgttagactgtccacaatttttctgatgttggaaacgcctaagcctgtatcaatgagaatagcgcatttttctccacataatagatagcaatgtgtttcttcccagtgtttgtattcgctaatagagaatgtatcacggtctatttgctcaatggtaaaccaattatccattctgcataattacctccaacaactaaatttcccggctaaaaccactttgcgttttcatctctgaaatgtggtatagtgccatctttataagggtcatatcgattttcattgcaaccaaattcttttaagagggcaatcttgtcatctggtgtccattcaatcagtgatattccatcaaacgcttctacattaccgtcgtccattttattcttaaaataccattcaacgatagtctgattgtctttatggaaaaactgtttgatgtcccattgtaagacggttccccgggtattccattcctcaaaccaaagtattatcttctttatttcgtgatattccggcccccagctttcaatatagatggcattatttgaaaaaatatcggatatacctaaatctttctttgtaagccacatatcaaaccaaagtctgataattctttctctattgtccatttcgcagaaccttccttgttaatttgatatttcagcttcttcgtcatgctctaattcaatcacattcaaaattccacagttcaatgctttgcagatacgcagtagtgtttccatactgatatgctttcccttgcccatgttggcaatcatattggtggtcagaccggcggacagccgcaagtcctctttcctcatgccacgttctttcaaagtgtcccatagcggttgatagctgatgtgcataggctcccgcctctctttccatcgtcaaatgttctgtacccattatagcagaaatcttgcgtttccacaatatttcttgaccgcaccgccggttccgtctggattgtgcttttcctttcttcacttttattacatttaattagccataagctgcttcatgccttggcttttagcgccgggattgtcatttccgtaaccttccagcaggttgatgacaccccagatgccgagaccagcgcccagagcgataacgagagtctgcaaaacggtgattgcctgattaaaaaatgccataaattatagttagccggaatcgttttgataaagtttcagtcattcataggcatacaaaagccggacaatccgccgcccggtttccgggggctgattccggctgtcctccttttttcattattttttggtgactgtccgccttgtacgccaatggtcccaaaagggcagttgcggcgaatagataagaccactcctttcacagcggaacagatttaagcaccctctgtatctacttcgtacacgtcgcagacctcattgggcttgagcttcagccgggtggacagaaatgcttcaatgtcaaaagcgttcttgtcgcttgcatcggctgtgtatttgaaattggggtgtttggtgatgtcgtacttatccgaaaggaaagggcgcacaccgcgcagctgaaggatgcacttgccgccgtccatgacggccagctcgtcctggctcatcagctctttccctaatttttgataattgagcgagtgggaagtttcccgcccacggctctctccggtgttgtaggtgtcgatggtttccttgcccagcacggcagccagttccttgagggtagtcggctccttgccgcccaggaaaatggaggtatccatattgccgatgatggtatcggcgttgtccttgtaaatggctttgagctggctttgcgcctgcaacaccagacaagcggagatctcacggcttcggatggtggccaccagcttttccagtttgggaatctggccgatgttggcgcactcgtcgataagacagcgcacatggaccggaagtctgccgccgtaaacatcatccgctttttcacacagcaggttgaacagctgggtgtagcacatggagatcaaaaagttaaagctatcgtccgtgtcgctcataatgaggaacagggcggttttcctgtctcccagggtgtccagctccagctcgtcgtaggaagtgacctcccgcagctccgcaatgtcgaacacagcaaggcgcgcaccgcaggaaatcaggatggattttgcggttttgccagctgccagcttgtactttttgtactggcggacagcgaaatggttgggcttctctgcctccagcgcgtcaaacatcaggtcaacggggtttttgaactcctcgtcatcctcccggacctccatcgcattgatgaactcgatgagggtggaaaaattctgttcctccaccggggcctcatagtggatatacccgataagggcgcagtacaaaagcgtttccgccttgacccagaaatcgtccccggccttgccctcgcccttggtattggcgatcagcgtggtgaccagcttcaagatgtccttctccgagtggatgtaggcaaaggggttatagtgcatggacttcttgaagttaatggtgttgaggactttgatccggtacggctcatagatgaccttgccgtgcttatccttcatgggtttgccgtccttgcccagcttggaggtgcctcgctggagcattttgccgcactccaccaggatggtgcctttggggtctgtgaccacataagagctgtgcatctgcatcaggttcggtttcagccagaaccgggtcttaccggaaccggagccgccaatcaccagcacatttttgtttctggcagtcttggggtctttgggacggctgttcatagtcaggctctcggttttcgtcagaatcacattgttctggaacaccgggtcgatgtaaggagcgatgtcctcatgggttccccagcgggcagaaccatactccatgccgtggcgatactttttggcgttcttgctcttgagatagaccgccagccgcaggccagcaccacagcacagacccaccagtaaatccagcgggtgcaggctgggccaccagcttgccagcgccaccggcagcgtggagaagaacgagagcatttttgccgaagcgtccgcgccctgcgccctgcgccatccttctccgaagttggtggcaaacagtcccatcagaatatacggcaggttcaaaatcaggagctttttgatgtcaagctgctttttcatcgttccagctcctttcgcctggtgcgatccaccacggcatttttgaccagctctttgaactggttcagctttgccagcacagacggacgctctgttttctctgcttttttcacttttttgccggtgtactcagtaaaggcggcggtcagcgcatccgcatcccgacctttgaaaaagatcaggtacttgggcggggaggtgctgcggtcttttttcaccgcataatccacaccgtatttccgggcaatcttttcaaactccttgatggaggggtcggtgatctcaatgttggatacgccctgattctgccctacaagctgcttgaccgtctgcttgccctggggtttgactgggatttcccgttttcgctgcttattcagcttcttttccttgcagtgggcaaggtatttacaaatggcggccttaaacagccgcccggtgaactttgtgccgttgactaccagcgttaaagtcctgttttccacttcttcctgcatgggataacgcctcctttccgcagattttgcagggatgggtcagaaaatttaaggcggaaccaccagccgccgcagaagataccgcatcatcatatcatcagcaggatgctgtcccgcagctgggcaaaaaagagcttgccctggggcgttaccagtgtataggagccggtatgcccatgattgcagtagtccttaacggtaaacaggccgtcgttggcaggctttgcataaggcagcacattcccggacggggcgcggtacacaaaccgctgttccagcaggaatcggacaaaccggcgctccggcacaaccagttctttggcggtggtgcggaggttggtgctgtgcttgaggtcgataaacaggtcataaaaggctgccttgccctccagcatggcgttttctttccgcagcaccgcattttcctcgcgctcggccagcaggtcggaacagagtttcatcatggcttccggggaagtggcaacctcccacagcttttctctggtgatgtaagccccgtgttttcggatagagggcagcacctcatcaaatacccagcgttcaaaccgttccgcagagggcagcttgctgtgaacgattaggcggtacacatcgccttcgggaataaatttcattcgctgaataccgccgttagaaggggtcggtaaaacgcagacccctttgcagtgggctgtgatggcatcagcggtacgttggtatccaagtgctttcgcaatatcctttccgcaaaacagcactttgccgtcctgctcaaaagtgcggatactgccgaactcctgattgctgaaaatttccatctgattcatagcgtaacctcctgtaaaagacattgttgtgggatgaaaaaagacggccttaccagccgcctgcgttcatatcgtgattgacctgtgaagtgtagtggttgctgatggtggtgggagcgttaaacagcaccgtcagcaggtattgcttcatgttgcggacttcggtggtgtttttctgcaagctgtccatgacaaaccggatatgttcgctgtccagcttcaaaaaacgggagcgcaccacctcatggggaaagtcgctgccagcgatccgggtggttttgcgtctggcacagacggtttccaccatcagctccacgatctcgtccaaatcctcccgataggtagcaaactccctgcacaggtagtcatactcaatgttctctaaaatcaaatcccgataattttctatctcggagactgacatcgcatcccttcctttccgttccggcagtcttgccgccgttttctcccggaagggaatagaatcgatacttgatccatctgttattattttttgagtattggatttctctatatttaattctgcgggcttttccgtatccggtttctccatatccgggttttccgtatctggtgaagccgtatccggctggggcgtatccgggttcttcggctgcggttgctcatagatgacatactcggtgtcgctgatccggccctgccgatcccgcagttgatggcgtacaatgtacccggcagtttccagctcccgcagcgcgccgccgatagcgtccacgccctccttgcagattttcgcaagccctctggtggtgtagttccagtcctccggcaaggacagcatcatggaaagcagccccttggccttgagggacagcttcccgttgcgtaaatgatggttgctcatcacggtataatctctggttcgttcaatacgaaatatggccattgacctcactccttccaaatttctcagggtatgaaaaacgccacactcctgtaaaaagaattgtggcggtcacgatttctgttcttttttcctgcgccggtaggggcgcttaggcatgggcggtttatccagcaggctattcctctgtgaaaacgggagcgtctggaaaatgcggtcaatgtcggcggtttccatatcatgctgggaacgacaatcctcccggattgcttcccggatttcctttacagtgcacatttcaatcctttcctttcgcagtaatggcttgtttatgagtggcggcggtgcttgtccggcttaaaatcgaggatgtgtccctcgatgatacgggcgtgccgcctgattttgatttcccggcgcttctggcttacgagggcggcctgatagccgtcctccgtaagaaacagccgcatttcatcaccgggactgccgtaggcgcaggaacgcaggacagaaaactcaatcatccggcgagtgttatcctgaaaacgctccacggcaagaatgttatgtcctttcagctcacgggctgaaatatccctcataggctgctcctttctcagcgttcatgctgttgctggcgttttttctgccactgttccagcagcttgataatggtttcctgcatcctggccggagtataactcttgggaaaatacttccgcaaagtgtccgaagtgaatgtcaccttgtccagatcgcttttcttttcctcgcccataatggcccgcatcacatcaatggataaacgcccctcttggctgaacttcttgagccgctgggcctgggagagagagggggtggcctgttcgctgtccatcgcgtccaaaagctggatctgttcctcttttttgaggaaagacagctcgtaggccggattaaaggcgattttcttttcatccaccatatccaacagttcgggaattagctcggttaatcggatataacgcatgatctgaatgccacttttctcaccagcatctttggccaccttgtcacgggcactcaacttctgttcgacttgaacagaagtaaggtctgttcttgctccctgatgtttgatggcctctaacttcatgcgataagcccatgctttttcactgggcataactttctcgcgctggatattggcatctaccatctctataaccgcttcttcatcggtcatatccctgataatgactggcatatcctccaaacctgccaactcgctggctcggtggcggcgatggccagaaataatctcatagccaccatccgggtcagggcgcacaaggccaggcgcacgaacaccgcgctttttaacactatccagcgtttcctgcatcttggggtcatcatccttgaaacggtaaggctgacctgtaaatggcacctcggtctgcatagctggataccctttaaagtagtgcaattgtgtaagggggatacggacaactctctcttcgtcggcttcctgacgttcctgctccgtggtaaaaagatcatctaccgatgccagctctacttttttcgcgctgcttttcaagtttcgtcacctcctgcgtcagatttttgtagctctcagccaccttgccgccagggtcatgggcaaaaatgctcttgccctcggcgctgatttcctttgccctaacagaatggggaatctcggtggcgaacaccttgattttgctgccgtaggtctcccgcagcagggcggcgatctccttggcaaagttggtgcggttgtccaccatcgtcagcaggatgccgtcaatctggagtttggggttaatctgtcgcttcaccttatttactgtttggagcagctgttctaatccttttgcgggcagatactcagcctggacgggaattatgaccctattggcggctgccagcgcattgaccgtgagcatacccagggagggctgacaatcaatcaggatatgggaatactgtccctttacggtgtccaggtattgccgcaggatagtctcgcggctcatggcgttcaccagagaaacctccatgccggagagctgaatgtcagcaggcatcaggtcaacgccttccgggtggtgcaggatgccctcaccgggtcgcagcggctcgtccatcaggatgcgtcccatcgcgtcggaaagggtaaagggtagcttgtccggttggggataacccaggctgatggtcaggctgccttgcgggtctccgtcgatcagcaggactttcttcccagcctgcgccaaaccgattccaagattggcacaggttgtggttttgccaacgccgcccttctggttggcgatggcgatgatttgcgtgttcattgacttcacctcatttctgattgttgctgttgcttctggaaatagaaaaagccgccactccaaaattaaaagtgaagtgacggctctttctatcgccggaatacgagttcttgaaatgaaaaaacacccagtcattttacactgagtgctgtatcaaattcatattcaattatccaaattaggtcaagctatgccaaactgccacagcccaaaacaaagggaaggagagctgaaaagcgccccaaaaacaccgcaaaaatcagctctcggttgtcctataatttaaccactaacccctttttttacccccatttttgccggttgtcctatatttaaccacggaaaattgggtgaaaacggctctcgttttaccaaatttagtcaaactatattagcccgtttagatatagtaaaaccccggaaaaccttgattttccggggtttttgaaccattttgatacggtttgaacagcagattatctcttgctgaactgaggtgctctacgagctgccttgagaccagtttataatcgcccctctgttccctgtaattctccctgataatttcaaagccaagcttattaacgtaaaaatcccgggatttctgataatccgatactataattgcaacatggtgaatcgtactcaaacgaatcataatcgttatctcctttcctggccgccaacgataaccggcacgcttcgcgcatcgatcaccgtcttccgtcagcgcagtcccgccaggcggcaggctgccattgcaatgataagtgccagttcaaatatctgcagaaaataaccggccagatctccggtcattccgccaaactcttttaccgtcattctgtagtaataacagaaaaccataaccgcagtaacaatgcagataatcccgctaattgcccctgcctgcataatccccgcagcggctgcggccagatatgcagccataatgaattgaaccgtcttcgtcttggcttttcccgaaaattcggcggccagaccgtctttcttcgcctttgggaaactgactaccgacaggccgctgagcgctctttccgccacgaacacgtatgacagcaggcagatatccgaaaattccagctccgagaatgcggctccgtaaagaagcaggtatactccgagtccgattatggcaaatgcccctgtatgcggatcttttaagatttccagtttcttttcccgggaaccgtaggatcttcttgcgtccgtcacatcgagaaagccgtccatgtgtattcctccggtaaccagaagcggtacggcggcgcctcccagcgccatgaacaattctccggctcccagcctcttcgccagccagataaacaaaaccaggactgcgcctgttatcaatccaatcagcggaaaaaaacacatggcatatttcatacgttcctttgtccactccacctgcggcaccggtattttcgaatacatggacagcgctatcaaaaagcttccaagcagattcattttctcatttcccttccctgccccttaatatggatcggaatgccgtatactacctccgttaccgtatccgccatctgtcccaggcggcagttgatttcgccaagcaggcggatataacgcatggtttccgccccgtaatccgtcccatcgcaaaagacttcattcgtcacaatcaccagttcccggcattggcggcgaagatgctccactccctccaaaatattgttcagggcatttttctcatcccggtaaaattcattcgatgccagatttgacatacactccaaaagaaccgaggtattttctccggcctgcggcaaggccttttcccgcactgcggcggccaaagccattttttcgccgatggacagcttatcgccagtggactgcttatcacaggtggatagttcgagggaggataggccggtataatgttcgatggttataaatcccttcccgctgcgcatttcccggtgccgtctgacacgtttccggccctcatcgtcccataccatcatcgttgccacataaatccggcggtgtaatgcgctctccgctatcagcttctccgcatattccgattttccgcttccgcttccgcctgtcacaacatgcagcatatgtatctcccatctttttcctgtattgtccacagacctgcaaaaggcgcagctctgcaaacagaaacctttagctgatttgctaaataaattcggcgttagagaggcttgtactcatcaatctcaatgtcttcaaaagtactcatcctttcatagaccgccagcgtcatatccagcagaggaaacagggcaaccgccccggtgccttccccaaggcacattccagcttcgatggccggttttttcccaagaaaatccagcattttcctgcctgccggttccgccgacacatgggcggccagcatatatccgcctgccgtctcattaattgccacagcggctgcggctgcggctgccgagataaagccgtcgattacaaccggaatacggaagatggctccgccaagaaatactcctgccagtcctgccagatcgaaaccgccgaccttagataaaacatccaggccatccgatggatccggcttgtggagttcaatccctctcttgatcgttcggattttctgctgaagccccgaatcgctcagcccggcaccttttccggtcacagcggcgggatccagtcccagcaggacggacgccaccgcgctgctcgtcgtggtattgccgatccccatctcaccggttgcaattatctgataccccttattcttcaattctccggccagctcaattccggccaggacggcaagaaccgcttccctcctggtcatggcggttgtctttataaaattatcggtgccttttctgattttacggtcaatcagaggatgtacggttcccgtctctcccagttcacaggccaccccgatatccaccggatacacatccgctcctgctttttcagccatcaggcaggcacagctttccccctttgtaaaattagaggtgacggccgccgtaacctcctgccccgtctgggtaacgccttcctctacgacgccattgtcggcacagaaaataatcaacgcctttttatcaagctttacagccgcagaacccgtcatcccggctattttaataatgtcttcctcgagaactccaaggctgcctagaggttttgctattttactaaagcggaatgccgccgcccgttccgcttccttatcagccggaacaagcctcccgcactgttcttccagaagggcggacagttgtccctccgtccagtcccggtatgtctcccactgaatttctgcttccctgcccggctccctgccaaggctgcgtcttgccactaacgtcattttaatccctttcagtccgcctattatctcactctgtatacagctttcattgttatatctacatttaaaacagaaccattatatcaaaatccggtcgttttgaccatacataaatgcggatgtttcattgatgatgggaggacacatccaaaacggagcggggatgatgttaaacaatcgtattggcagcgcgaatcagcaaggcgagacttcgctctcctttctgaatatcacaaaaatgcatcatcaaacactatcccgccctgcgcaacacggaactgtccgcttaatgtccattcattcttaaggcatgtcaggttgccgtcatttgtaaaacagaactgtttgtcaatcttttgcataagctagtttaagacaatgtgtaacggatattttgcagatatattccgcaaaacacatcaaatctatgggaaaggaccgaattaatatgaaaatatacaatgatgctgacagttataaggataagaatttatgcaattgttgttgtgatttctgcggtggatgtaattgccgccactgctgccagggaccgcaaggtccacagggtgaaccaggaccgcagggtgtacagggagcacccggtccgcaggggccggctggacctcagggcttacagggcgaaaccgggccgcagggacccgctgggcctcagggattacaaggtgaaccgggacctcagggtatacagggtgaaaccgggccgcaggggcccgctggacctcagggtatacaaggtgaaactggaccacaagggcccgccgggcctcagggcctgcaaggcgaaccgggaccgcagggacccgctgggcctcagggattacagggtgaaccgggacctcagggtatacagggtgaaaccgggccgcagggacccgctgggcctcagggattacagggagagcccggaccgcagggtatacaaggtgaaaccggtccacaagggcccgccgggcctcagggcctgcaaggcgaaccgggacctcagggtatacagggtgaaaccgggccgcaggggcccgccggacctcagggtatacaaggagagcccggaccgcagggcacatttgagccaggtgatattctattttatgttaatggtaacgggggaccgatccccatcagatttggtgaagatttgaattttatatctcccaatttggatattttcctaagcgataatccagcaaccgtaaatattaatgacgtcaaagtggctgacgctgccttcggcggactctattccaacattgcccagtcatttaatctttctgccatcgggcaggttgaacagctgcaacagaataataacatgccctcattcaatatcgggcaaagccaaaatgaactgcagatcttccttccgggcgaatatgaaataaactttatgattcgtattgccccggttgcaactccgggacagacaatttctgcaggcgtgcgtcagaacggaagctttattgagtccaccatgcagtttagcacgctttctacaacaaattataccgtcttgcagggaagcgtcattgaatttttaagcgggcagatagatttggcgtttctgtccaccggagcagcaacgtttgagctgggaatgcttactaatgctacactgacagtggaacggctcacaccattcccgtaagaaaagaagcggcctgggcgtttaatgtccgctaactatggtcttacaaaccaatcaggccgcttatccccaaaacaggtgacagattaatccgataggaaacccatcgccgcttctgcaaaacgtgagaaatcacattttcgttgaagcggcggtggtacggtaacgcagcctgatggtttaactgtatacattacttggcgaaagccccagcagcgtacccgcctatttattgatgccgatgacctgtgtgcggagcgtacaggttatcgttactcaattctcacagaactcatcaccggcatttccaccggcctattccacgtttcggccccatgtgtcggaagcgcggctatctgatccagaacatcaaacccggacaccatctgcccgaaggctgcgtaacggccgtccagcttgtgcgcatcctggtgtacaacaaagaactgtgttcccgccgtgttataaccgtcgtcgcgggccatggaaatggctccccttatatgaggaattgggtttgatactccgttttcctcaaactcccctttaatatgccagtcgctgtccgtcatgatatcattgtccggggaacctgcctgaattacgtaatctttcacaatccggcaccaggccagaccgtcatagaaaccgcttttcgccgtatcctcaaagttctttactgtaagaggtgcatgctccggatataattcaaataccatctcaccgaagccctctgttgtaataatacatctcatcattttccctcctgctagaacatgtttgaaaactgctttccgtcagatgtgcgtcacactttgtgggagattgttccccgaagtgggacgtgcagatggcgggaatgaattttcaaacacgctccactcccgcttttatcaccttttccgccatccggaaaaagacagttttgtgaacctttttcctgtccgtcaatccaagaaatgcgcagcgtctgcaaccgattttcatcactgctgcagacgctgcgcaatctattattgttgcctgacgttaatttttattttgccattacctttgcatttttaaagtaaaggttagaggaagatgtcatatatacacccttgatataatcctttaccagataattattagatttatagtataatggcaatactgcatactcagatgatgcgatattatcggcctgtttaacaagttcaccgaatttgaccggatccttttcaactttaatctgatcaacaatcgcatcatactctttgttgctgtaatttccgttattcgtcacgtcatctgtatacattaatggaaggaagctcatagggttaacatagtctgcgctccagcccattgctgctacttcatagttgcctgactgaacatcgctgtagaatactgcccagtcagcggaacttacttccaccttaatgccgagattctgctctaacatttccttgattgcctcagcaatcttctttacattatcatcagaatagaaagaaagctgtaaagttgggaacccctcaccatcaggatatcctgcttctgccagcactttctttgcctcttcaggattagcagtggaggacaagccaaaatctgaacgtccgtctgtcaaatctttaccgtcaaccacgtaaccaggagcgtaaaaactatatgctggaactgcatccaactgtgctacattattaataagagcatcacgatcaattgccagacatagcgcttttcttactaacggattattataaggctctttttcacagtttatattataataaacagttccataacttggcgctgtgacaagtcccgcattttcagctttcagccttgccatatcgccggacggtactgttctgacaccatccacctcattattttcataagcagtgagagcagttgatgtgtcaagtatataacgatatgttaatttctcaagcgttacatttccagcatcccagtaattttcatttttctcaagtataaaactctctcccatgttcatctgggtaatcttaaatggtccattacaaacatatgtttctgctgaattggtccacttatcgccgtttgcttctaccgtagctttctgaaccgggaagtatacccacatgcttactaaatcaacaaagtatgggcatggagcttttaaagtatactgaattgtcttttcgtccagcgcctttactcccacatcttcagctgaagctgttccggcataatattcttctgcatttacaacatagtcggaaatcatgttaagatactgtgcagtcgtcgatggtgtcaaaacacggagtgcagaatatacatagtcatctgctgttaaatcactaccgtcactccattttaatccgtcccttaaatggaaggtaaattcggtaagatcatcattcgactcccaagattctgcattacccggtactacctctcctttttcattataggtcacaaggccttcaaaacaatttaccagaaatggcgttgcaaacgaattgttcgtaattgtcggatcgattccgtccggctcattgttaagtacaaacgtcatctcctgaacatcggccagagtatctgccgcctctgccccctccgtggatgcctcgcttcctgccgcctccgtcgtcgcatcagcgattgtctgaggctctgtgggcgtactgccgccgccgcagcctgaaagcacggtagtgcatacaaggccgagggctaaaagcagacttactttctttttcataatatttctcctcctttttggatttttatgtttcaggcgcacagagtatctgttgttacttttcacggccctgctgaaaaacgcattttcgcgccgtacaactcgggattttcatgcaaaatgcgcacgaaaacacctcgcggaatacaggccatgaatagtaactatctgttgcctctgcgccgaaaaacctgttggtgcggtgcagcctcaccgccggtcagtacagatgacaggccaccatatggccgttccccgcgtctttcatctgcgggaccgcctcgctgcaggccggtttcgcataaggacatctggtatggaaacggcagccggagggaggctttatcgggcttggaatatctccctcaatactgctcttttccttcatcttcgccagcttcggattggctatcggaatgctccccagcaggccttttgtataggggtgcagcggatttttataaatctcgccggcttcacatacctctaccagctgccccaggtacataactcccacatcatcggatacatagcgcaccatcgataaatcatgggcaataaacaggtaggatacccctttttcctcctggaaatctttcaggagattgatgacctgggcctggattgacacgtccagcgcggaaatcggttcatcgcagataaccagctccggctgcaatatcagcgccctggctatgccgacacgctgtctctgtccgcctgaaaactcatgtgcataacggttggcgtgttccttggtaagtcccacccgctccagcatcggatagacaagctcattcgactgatccttccttttcacaacattatgtgccaccagaggctccgctatgatgtcgcgcaccgtcattctggcgttcagggaagcgtaagggtcctgaaaaatcatctgcatcttttttctgtatggtttgagctgtttctggctcaaattcgttatatcatccccgtccagaatgatctgtccggaggtgggatcgtacattctgataatcgttctggcacagcttgactttccgcagcccgactcgccgacaagccccagcgtcctgccctttttgagcgtcaggctcacatcgtccacggcatgcaccacctgcctgccgcctgctttaaaatgttttgtgaggtttctgacctccagtatattctgctcactcatggcttgctccttagtttaaatggattattttcatcggccggtgcatccggggataaaaggaaacatctggaataatgtccctctcccactgcgctgaattccggcaactccactgcgcacacgctcctcgcataaggacagcgcggtgcaaaaggacagcccttcggcggattcgtcatatccggaggtgaaccgggtattggacttaaccgtacctctttgttctgttcaatatcaggtatcgaagccagcagccccatcgtatacggatggctgggatgctcaaaaatatcttcaatcggcgcttcctccattacaaggccgccgtacataacaataacacggtcgcacagctccgccacaacgcccaggtcatgggtaatgaaaataatgctggtgccgtactccttttcaagctcccgcaactggcgcaggatctgatcctggatcgtcacgtccagggcggtggtcggctcatctgcgatcagaagctccggcttgttggcaagggccatcgcgatcatgacacgctgacgcataccgcctgaaaattcatgaggaaatgagtggtaccgtttttccggttccggtatacggactctggagaaaagctccatcacctcttttttcagttcctccctgctcttgtcgggatgatgttcccggatcatctccgacacctgttttcccaccggaatcagcggattcaatgaggacatcggatcctgaaaaatcatggcaatcttctctcccctgattttccggatttgttttttggacagcttcgtcaggtcctccccctcaaacaggatggagccgtccttaattctggccgtatctgccaaaagacggagtatggacatggaggtaacgctttttccgctaccggactctcccacgattccgagaatctcccccttccccacagagaagctgactccgcggacggcctgaacttcaccgccgctggtcataaacgaagtcttcaaattttctatttttaatatcggttccatgttctcactccttactttttcagtttcgggtccagcgcatccctcaggccgtcgcctacaaagttgaaggcaaacatgataatacagatgacaagggccggaataaataactggtgcggacaggaacgaagattttccgtcgcgtcgttgcacatggttccaaggctggctaacggcggtttcaggccgatacccagatagcttaagaatgcctccatgaagatggcggacggaatcagcattgtaaccgttaccagaatggagcccatggcattgggaatcaaatgttcaaacaaaatcgttttcgtggatgagccgatggttttggccgccaggacaaattcctgctccttgaggcttaacacctgcccccggaccaccctggccatatcgacccagtacacggttcccagggcaatgatgatactctggattccctggcccagaaggaccataatcaggatgacatacagtgtaagcggaatcgtgctgataatatccacaatacgcatcattaccgtatccaccattcctcccgcatatcctgatataccgccgaagagtattccaatcaccatattgacggctgccgccacaaaggccaccatcagagatactcttgtgccgtacatcagtcgggtcaggatatcccgtcccaggttatccgtgccaagcacataggatttgttccagattttagcagtcggatagattgtcttcgtctccggattggcaataacataaggtttctgcccgtaatacaggcctatctcagtgccgttgcagtcataaatcgtcattgaccggtccgactcttcccggaccttcttaagctgtacgccgagcttgccgtccttatctacctggagtaccttcagcgcctgcgtgatgtagagatatccggaattatccggtgtctcaaacaccttcatataaggaggaatattcactacctccagattctgggtggaataactgtatttcgtaaacatcggtcctgcaattgcaaaaaacagcaggaacagaataatgataaagcctgcgatagcggttggtttcctgtggaagcggtaccacacatctccggcaaaggttctatttttagtccaaattttctcgcggtcctcattggaggactcaagcatttcccatttattatccattacacatccccgtccttattcgaatttgattcttgggtcaatcagacagtagaaaatatccacgatgaaaatcatcgccatcaaaaatgtggcgtagaaaatggtaacgcccatgatcgtggtataatctctcacctgcacgctgttgacaaaatgaactcccaggccagggatagcaaaaatcttctcaattacaaagctgcctgtcatcaggtttgccacagtgggtcccagtacggtgataaccgggatcagcgcattcctcatggcgtgtttcagaacgaccttcgtctccgaaagccctttcgccctggcggtgcggatataatcctgtcccattacttccaggagactggaacgcatcagccgcgccatatagcttaaagaatatcctcccagagcgataacggggagaatatatcccttccaggtatcgactccgtaggtcgggagcagattcagccggaaggaaaatatgtatatcagaacggaagcaatgacaaaagaaggtattgtaacgccgattgtggcgactgccatcagaaccatatcctgccacttcccgttcttcactgccgccaggattcccatcgggacagcggccagcaggacaaaaacaatcgtgatgcatccaagctttgccgataccgggaaaccgttggtaatataatcacttacctgtttgccggtatacttataggaaggtcctaagtcaccatgcagtatgttgcctaaataatcaaaaaactgttccggcagcggtttatccagattatatttttcattcagtgcctgcagcacctcctccgatacctgacggtcgctggtaaacggcccgccgggtacggcgtgcataatggcaaaggtcagaagcactatcagaaagagcgcaatcagcatcattccaagccgttttaaaaaatatcgtaccatatcattccctcacatctgtcttttcttacggtttcttatctgtccgcctttaatctccatatggcgttcaaatgtctctgctggaaacacaaaaaccgttatttatggtcgattataagccttagtggcgcttcttgtcaattggtttctcacatcaccagtttaaagtggggatttagttaagcaggtgaggacgctggccgtaccggcggcgtcctcacctgcttaattaaattcctcgaataatgcccccacagcatcaagataagccactgcattctgagctttttttattttctttatatacttctccttttttccctcaccgccgtcatcgaagagcccggccatataaaaccataattccttcatcttaaagagagtatttctgtctcccgacattatctcctgatagccgtagaagatctggtcatggaaggcccttaacgtgactttatccggctttgaacgctcctttatcccttttacttcggcgaaaagccacggattggcaacggctcccctgcctaacataatacttttaagcattggaaattcatcttccggaaagtctgaccggaagcgggcgcattcttcctttgtaaagatgtccccattataacagaccggattattgctgcccctcactccgcggcaaaacacctcccgttccggtttattggcataaaaatcactgcggaccctgggatgtatgatcaattctttcagagggtaccggttatagatttttaaaagctcttcaaattcatcgtggctttccataccggttcttgttttcacggaaacctggacagcttccgtttccagcccggaaaatacctgctccaaaaaacgatccagttcatttggaacggacaggaaaccggcccccttattttttgcggtcacagtggcggagggacagcccagattcaggttaacttcccggtagccatagctgctgagttccttggccgcccagataaaatcctccgctttatttgtcaggatctgcggaaccagggatatcccggcattatgtccgggaaggatatcatttttctcccgggaactcagcttatgattctgggcaggcgagagaaagggcgtaaagtattgatctgcgcccggaaaaaatcggtgatgggcattccggtagacatatccggttatcccctccatcggtgcaaaatagtatttcatatcgtctttttcctccataacctgcactgttccagccaccattccgtaaaagacggagcagacagataataaaaatgcggaaagccgcagatccggggtccatcctggtggatacagcgccagctcctgtcggacgccggtttctcagccagccagtcctcccccggatcaccgctctcccagtagtgaaattcatggcctttaattttcattccgccaggccctgtcagactgatatagccgaaccggccgagtcttcccgtattaaatgccttttgcttgtaaattccagccattttataaacgctgccgtcactgccctcgagcatctcatgtaaatataaaaaacctccgcactctgccagaacaggcataccggccagccaggcctcacggatggattgaagcatttcttcattagaagaaagcttctctgcataattctcaggataacctccgccaagtatcaagccgtccaggccctttggcagattcctatcgtgaatgggactgaagcagacaagctccgccccctgctcttttaaaagctccagattctcatggtaatagaagcagaaggcttcgtcccgggcaatgcctatccttactttttcttccgtatgtgctgaaaaaaatgcctgacggttccccgcatcattctccggcgcgctgggaagaagctccttcgcctgattcgctatgtccaggatgcgcccgatatccaccgtctgttccatctgccccgccagcttttctatcctctcctgaagcgcttttgtctcccccggcagaagaaggcccaaatgacggctttcaaaccggtattccggtgaatcgggaagacagcccacaaccggtattccggtctccgcctcgatccgttctttcaatcgtccgcaaacggaaggtgaagtccggttcagtatgattccctctatccggctgtccttcctgagagctgcaaatcctttcaccgtagcggccagggacagcgacgctcctttgccgtccaataccagaatcaccggagtctctgttatccttgcgatgtcataggcgctggcccgggtatcgattccccccacgccgtcataatatcccatcactccctcgatcacggcaatgccggctccggcccgctctgctgaacggacaaaattttcctttacagccccctcctccaaaaagaagctgtccagattcatcccgggaatcccaaggacataacggtggaacatcggatcgatataatcaggaccgcacttaaacgaacatggatgaagccctctctgttttaccgcctgcaggaagccgcaggtcagcaatgtcttgccgcttccgctccccggcgcagcaaacatgattctgggcatcccctctttctcatgcccggaggacggttctcttcctccgaatgatatgatatagacgggattctgcccctgcatcaaatgatagctccctgtcctgaccgccctggatgcctgaacctgtacaatctccgcctcgattccccggttcttaagcatggcagtcaccaaagccagagattccagggcgatcacattgataacaatcctcatctgtccattgagggaaagcagcagctcgacaaccgcctccagattgcccgacgttcctccgataaatgcatgagtagccaccggcgttcctccggccgcctccccgtccccgctttcccccttattccgcctgtccgctatccgttttatctgttccagggcatccccttccaccaccgtcaggtttttaagtccggccttctctctgttcttacaaatcagttccaccgcctccgccttcttctcgaacgcatatgcggcctttatggggcggcaaagcagcgcctcgatggcgacggaaccggttccggccccgatatcccaaagcagggaaccttccccgagttccagtttggacagggctaccgcccggacctcgctctttgtcatcggaacctttcctctgataaaccaatcatctctcatcattttcttcctcaattaatacaaggctgagcggctcaaattctctgccgcacaggctctttgccgaaccttccgttatctgctcatcccggtaagaaagtttctcccccaccgtaactttcacgtgcccgaatcccgactccgtgagacggcggcagagttccccggcgccgttcttcccaccggttagaaggaaaatcttccggcagccgctctttagagccgaagccgcatcaaactcacagccatgggccgatgcaagcagggcgtcatcccaggagattccaagcctggccgcaaaatagctgaccgaagaaatacccggcagcacccggaagctgcagccgtttttcttaagcctctccgccagttttctggttccgctgtgaaaaccgctgtccccggaatacagtatgacggcgcgctgccagtcatggtggagccgcaatgcctcctccacctcaaagtccagataagccgtcttaacggcaggcaattctccctccgtctgttcccgtttgatacaggcggccgccgctttaagcattctgggcgctccaatcagaaaatcgctgtttcggatcgcctcccgcacctcctgtgtcatcagcgcctcagagcccggtccgatgcccgcaagcagcacctcccgtctttcaaacggcgttcctctgacggaaaaccggctcagctgtgaataaatttggttcatcccggagccggtttctttcggatgtccaatgataatcactgaaacgccgcattccctggcagcctccagcttctcatcgaagcctcccgcctttcccgtctccttagtcacaagataggcggcgtttgtctggcgcagcatggccgcgttcatctcctttgtaaacggtccctgcatacaaatcaggtgtttacccgtaatgccaagctcctcgcatttcccaactgcaaatgaggagggaaggacgcgcgcaaaaatccggtgtttcagtttttccgttccggcaaacgccgccagttcattgctgccggttgtgacaaaaatatttccctttgtctcctccagccatttggcggcctcctccggtgtggaaaacagctcgtctcccgcattttcccgttcatcctccgtatttcttaaataccgcagatatgcggttccggtatcacggcaggccgactttatattttccgtcgcattcctcgcgtacgggtgagtggcgtcaactacaagctctatcgcttcgtccgcgataaatgccctcatctgccctgcatccatggggcctgtcaaaggacgtacatacagatcctccttcagaagctcccttccatactccgacaccacgctgacataagccgggatcctgttttcactgcaatattccgccagaatccggccttccgtcgttccgccgaaaatcagtaccttacacatttttataccctcttggcgtgaccattctgccgccggcctcctttgtcatcctgttgccgataaacacggtggtaaacatatcggccggtgcatccttaagctgtttcagcgtcattatttccatatgttctcccgcgcgcccgatattcctcacaaggccgcagaccgtctcctccgctttatattccagcagaatctcacaggcccgtttcagataatccgaccgcttcctgctcgccggattatacaggcagatattgaagtccccctccgccgccgctctgaggcgcttctcaatcacttccatcggcgtaagcagatcacttaaacttatcactgcaaaatcatggcccagaggcgctcccagaacggcccctccgctcagagccgccgtaacgccgggtatcacctccacctccacatcggggaagcctgccgccagcaaaagaatcagaccggccattccgtatacgccgctgtccccgctgcaaatcatggccgtcacctttccccttgatgccgtttcaagagccatcagacagcgttccttctcctgccgcatcggcgtcgtaagaaattccctgccggggaaatgttcctttatcagatcaatataaactgtgtatccggctatcacgctgcattcttccaatacctgcgccgcccttatcgtcatctgctcatacgctcccgggccgatgcctaccacgtataatttctttttaagcgcttcttccttcactgctttatcccgcactttctcaatctctattgttttatcctgcatatgcactgttgttcctctcccggattattttatcggatatctaaaacgttactgttcacacggttgtattccgcgaggtgttttcgtgcgcgttttgcacgaaaatcctgagttttacggcgcgaaaggcgctttttgccgtttctgtgcatcgcgaagcgtgttattgttcgcagcacgccgctttttggcggggtgtgaacagtaactctaaaaccgaatcgtaatttcttcgactgctatagccgcggtcacagaaggaaaaactcttcttcctgctgccaggacggctttttttcccctcataccggcccccgccagagcggcgcgctcacagacatttccgacgccggtaacgccccttacaaattctgattcggcaaaactgccgtccaccttctgaagctcttctgctgaaaaaacgttccacaaaagccctcgcgccgccgccagctctacaagcgcggcttcgtcccgcttcagctcaatgctcgccagcattctgacagctctttcatcaaacccgctgccggacagcatctgtctggcagcttcctccaccgcagcggtagaaacgcctctccggcaccccatgccgagaaccgcagccctgggaatcaggcggagccggctggtacccctgccgggaaaaccggcgctgttaccgtccgaactgtggcaggtgacatggatattttttcgccgccataccccttcggtcagcggctccggtattctgccctccaccggaaaatcactgaaaaagcctaccggctcgccccgcaggactgcggcggagatttccttcgcctcctttaaatcatcgatcgccagttcatttttctttgcaaacaaatctaccgcaaaagcatggtttatatcggtagccgttgttatcaccggctgtgcgcccaaaatggatgccgccgccagcgccagttcattggctccgccaagatggcccgacagcagggaaacggtaaaattccccagctcatccaccacgatcacggccggatccctgtcttttcctttcaaacagggcgcaatcgagcggactgcgataccggctgccccgacaaaaaccagtccctcctcatcccgaaaggctgtctccacgaatttactcagagggattttaagcttctgcaccgaaaaggcccgggactgatgtcccaggtccttaaatcctctctccaaccgctccgccgtccttcctccctgaacggtaaaactaataattgccagcctcatccttatgctcccccttctcatccgccagccccgtcctgaatccggtggtaaaggcggggtcatagagttttgatctctcgtagcagttgtgggcaatggcatcgcctaccaaaatcagcgccgtctttgtgatatgctccctggcggctgtctcattcagtgttcccaccgtgcagagcattttcttttcatccggccacgttgctttatagacaatggctgccggcgtatctttctcatatccgccccgtatcagctcctcggacagcggcccgagcattcctgtacttaaaaataccgccatggtcgccctgtgagcggcaaatgacgcaatgctctcccgctccggtaccggcgttcttcccgccatccgcgtaatgataacactttgcgatatgcccggaagcgtgtactccagattcattgatgccgccgccccgcagaaggaactgacgccgggacacacatcatatgtaattccaagccggtccaggaagtccatctgttcacagattgctccgtaaatactggaatcgcccgtgtggagcctgaccgtctccattcctttatcctccgcctcttttatcttcccgatcacctgctccaatgtcatccccgcactgtcatggacaagacagcctttcttcctgtactcaagaagttccggattaaccagcgaacctgcataaataatctgatccgcctccccaagaagcctggctccccgcaccgtaataagatccgccgcacctgaaccggcccctacaaaatgtaccatctgttttcctccctgtaaattctctgcaacatctttatcttatatttcgcatttattcatatttattaataattatacatatatgccattgttccagttatctatcttttaatgctctgtccttaacgataaccgcgctctgctcacaggccgccgccttcaataatacggtaagctccgccgctccttccgtcgccgccagaagccccttttcctggttaaacagaaccacctctgtttttacggcgaaaccatcctccaggttcttttttacccggcccgccgcctcatccataaccgctctcaggcagccctctctttcaagaaattcggctgcctcatctgtcgtattcatgccatggagccggtcggccgcttccggcccgagccccgcctttcgggcgcagtcggccaggatctccattcttctgtctccatacttcgaatgggtgttcatcacgcctcccgctaccttgatgagcttcccaagatggccggcaagaagaaccctgtcaatcttttcttccttcatcatacggaaggtatctcctatgtaattgctgcacttgacaaaagaggacatatcaagcccaaattcctccctgagaaaacgttccccgtaatttcccggggctgccgccaatattctcctgccctccgaagccctgactctgatatccaggcgtatcgtctcgagcagcgcattctcgctcatcggattcacgattccggtagtgccaagcacggatatccctccggttattcccagtgcagggttgaaggtcctgcctgcaagctcctttccttcgggtatggaaatctctattataattctctcgtccggccttccatagcggcaccttgcctcaaaagccgcctcaagaatcatctctctgggaaccggattaatggcatagtgcccaacaggacaggatagccccttctttgttacaatcccgacgccttcgcctccggtcacataaactcccggataccggtccgaagtataacagggctgtcccggatcttcctgtcccgccagacatgcttttgcacaaatcagagttccgttcgtgacatccgggtcgtcacccgcatcttttttcactgagcacatagcccagccacccttttcagcggtaaaatgaacaacctggattgccgcccgccgtccgcccggcagaagtactgaaaccgggctttctttcgtcccggagcagagtaaacgcacggctgcccaggcagccgcggccgcgcaggttcccgtcgtatatccgcttctgagtttatttttctccattcctctttggcctttccccagcagaatcaaaattcgtataaatgatttcgatatccattatatgggatcagttgttatctttcaatacttcctttttcatttctcttttccgctttgtaataagaccgccgatccggccgctctctttagccgtcagactgcgccagccgccgtttatcaccttgtctgccagccccagttcggtggcaatttcaaatttcatcatatcctccggtttcagatccgccggatcgaatttatcgtttttcttagctttattttccataataaaagcacactcctttccaaaatgtacttagagtatgccccgcggtttcctgtatatacaaaatttatatatttattccagattatagcagttcagacagcataactacttgtgctccggttttaataccctgtaaaatacagttatagttgactgcactattattcagaatatacttaaatcagaacacacttcaagttttttacatatttcgacatgtttttaccaacatttttttcaaacatcgctgctattttgttaaaatagaaacgagaatttgtaactaggggagatttaaatgaacattgctattatagaagactccgggcaggaactgtctctgctggaacgctgcctccagtcatacctgtcaagccgccaggtgtacagagtaattgacacctacactagcggagaagcttttttagaaaactggccttccaaatcctatgatttggtttttctggacatactgatggagggcatctccggcatagaggttgcgagaaaaatacgggaaaccgattcggaatgtcttctgattttcatcagctccagcaaagagtatgcgcttcagggctttgaagtacgcgcctttgattatctgctgaagccgctgtccgaggaacggtttcaaaaaaccatggatctgtgccagaatgaactggctaagcatatccgttatatcgaggtaaaagaaagccgcacgctggtcaaaatacctcttaatgaaattatctataccgattattataatcactatattcaaatccacaccgctgccagactgatccgctcctaccagcagttcgacgtgttttcgccgctcctgctgtgttatcctcagtttctctgctgctaccgcaactgtatcgtaaatatggatcatgtagactctgttgataagcacgactttgtgatggaaaatggagaacgggttcccatcacccggggcaaccgtaattcaatttaccaacagtatgccgattatcagtttttaaaaataaacggcggtatttaaaatgtatttttatgcacaaacaacaggcgcagccatgtccgctccggacggctgcgcctgtcttgaatttatgtctgctgctttaattgccgccggtgaattgtatctcggcagaacctgccgcgcagtcaatcttcaccgtcttcccgctctgagcatttatttttttatcattggacaggcccgaataaacagactctccgatcacaacatttcccaccgcattttcaagataaaagttataatcccggtcactgcccggcaggaatacacggaccgccccggcctttgactcagtctccaaataggtttcgaaatcgcctgatgccgtaatgctgccggcctccaccgtgagttctgcatttgacgcccggaagctgccaatcctcacttcaccggcctgtacctttgcctccagatcatcggcgctgatggctccggcctccatatatccggcttttgccttcagctccgcttcccggaaccggtatccggaaggaatttccacgattccctctgtatagccggtaattctgccggaccatgacgagcctctgtaagaaaatgaataatccacagagagttcatttggcccgtcattctctgctttaatcctggcataacggtcttctttcatataaacccggatttcgttagtcagttcaggattttctacaattttcaccgccgccctttcggcttcaatttcaatctttgcaatattggtataagagccgacgagcatcatttcgtttttctcggaaatgttaaaatcatcggaataatcccaatcctcttccggctccaggtctgaatcgaagtctctgatttggactctgccaggccgcagggcattcccgatgctcttcattacgccgaaattaaaatggtatccggccaggctgctgtatgacttctcttggacattcccgacagcagccgccagcgctgtaatcgctgtgccgataaacagcagggttactccggctattacaattcctttcatccattttctcatctctcatcctccttgcggcaattaccgctctgattgccgggattcttccctcctttatgaaacaatttctttacgaagccggcgatccccataaccgcccacggaagaaactttccatagaacagccaggaacagcacagcagcagtaatcccgcgcctgtaaatacaagacccagccctatgctcataacgccaatccaaaagctgccgaagagctgtatcaggccggtaaccaccatggctatcccgccaagaataccggcaaatgtcaaaactgcaagaaccagcaggcagaccgctagcacagcaacaaatccggtagcagttccaaacgcgccgaacacggccgctatcacaaatggtcctgcaaaaagaatgcccagggctatcaacaggtacttccaccactttccgtcatccggattagcgccctggctcttatcggcataacttcccttttcatagtaacttcccttttcataatttccccggctgccggaattaccggttctttctgctccccgatatccattgccccggtattccctgtctctgcggtactctccgccgctgcgggattctccgtcccggctatgctcctgctgctccctgcccttcacagccggataggacgatgtattgaaccgatgatcatcatagccgttatctgtaaattctcccgcgccttccataccttctaaaagttccgtgcggatcatcgaagcaatccgttccgggcttccgaatccttccagaacctctgcctctctctccggaccggcctcctccagatagtcgctgtagtagtctatggcatctctcttatcatcctcctgaatatcctgaagcagatattccagttgtcttataaattcttcttttttcatcttcttcatacctcccccaggatttctgatattctgcgtgagtagatactccactcactcttatagaggttcagctgagcgcgtccgttctccgttatcttatagtatctcctgtttcttccgtcaatagccatatcataggtttccagacattcttctttctgaaggcgtctcagcaccgggtacagggtcgattctgaaatttcaatagcccggcggacatcctgggtaattttatacccgtaagttccctgattctccctggaaacagccgccaagacaactgcatccagaagcgctgctcctgtgttaaataccattctctcacttcctgttctgtagactttgtttaccaataggaacttgtgttactgttctatcctttataacgagttgcggttcatgattactgcaataatattataatatttttaatattgtttaattcttaatattatcttattatcaatattacttttctttcaatattatatgttatataatatataagtattataaaacacaggactgatattgtcaatcctgtgtttctgttttctatatatgcaaaagctttaactgactacagcagcctgtgcgcggagcgtgcaggttatcgttattcagcatcttcctgagctgccactgcttcgatatcaacatcagcgatgtcttcatcaacaggagcctcagccggagcttcaagagcctttgtgctgagactgatctttctgtcagcttcgttgaagtccacgactctggctgtaatgatctggcctgcagataatacgtcggatggcttctcaacatgctctctggaaatctgggatacgtgaagcagagcatctacgcctggctccagctcaacaaatgcaccgaaatcagtcatacgtgccactttaccttcaacaatattgcctacagcgtacttctcggcagcgttagcccacggatttgtctccgggaacttcaggcttaatgcaaccttctcgccgttgatgtctttgatcagagcggttactttatcgccaaccttgaaaaccttcttcggattctcaactctgccccaggacatctcggaaatatggagtaaaccgtcggcgccgccgaggtcgataaatgcaccaaaatcggttacattcttaacaacaccctcaactgtctgtccaacagcaatcttctcaaataattccttctgcatagcagctttcttagcaaccagaagctgttttctgtcgccgatgattctgcttcttctgccgttcggattgaattctgttaccacgaattcgatctcctggcctgcatatttggataagtctttatcataggtatcggaaaccatgctggccgggataaatactcttgttccctcaacctcaacaacgaggcctttctccattacctgtgtaactttctctgtcaatacttccttgttctcaaatgcttctttcaggcgttttaatcccttatcggcagccagtctcttataagataaggatgccatgccttcgccgtcatttactttaagaacctttacttctaattcgtctccaacggaaacctttgttgttaaatccacatttggttcattcgtgaattcgcttctcgtaatgataccttcggacttacttccagcgatactgagaataatttcatcttcttttacgccgatgacctgaccggtaactgcctctcctgcacgtaatcgcttaattgatgattcttcaaacatttgttcaaaacttaattctgacattagtatgaacctcctcgataatttgattcggggttgatgcccctgctgtaatacctacgctgcgcacagaacctgccttttcaggtttgaaatctttcagtgtctggatatagtaagtctccttacattcccttcggcaaatctcatacaacttctgagtgttagaactgttccttcctccgatgacaatcataacatcaacctgtgaagctatctgccttgcttccacttgtctttcctgtgttgcattgcaaatcgtatttaaaacaagtatatcataacgcgttttagaaattttttcaactaaatcttgaaatttattgtagttaaatgtcgtctgggcaacaatacacagcttttcaccgtctgaaatctgtaatttttcaaattcttcagccgtttcaataactaaagtatcgtcatttccccagccctttattccctcaacctccggatgttttccgtttccgactataatgacgcgccggccgttttcattctgttcgcttactatccggtgaattttttttacaaagggacaggtggcgtcgataatttcaattccgttcttctcaagaatatcataaatatcttttcccacgccatgggaacgtatcactacgacaccgtctgtaagctgcctcagttcttccgccgtctcgagaactttgacgccccgttcctccagatcacggaccacctcttcattatggataatcggcccgaaggtgtaaatcggcgtttttcctttttctatctgctcgtaaaccttttccaccgcccgtttgacgccgaaacaaaaaccggcggtctttgcaactgtcacatccatattaacacccgcagcagcccttgctgcccgcatcctccaccaggctttccatctcgcaaagcacttcctcaagcgtcatctcggaggaatccagaagcaccgcatcttcagcctgtgcaagcggcgcaatttcccggtgcatgtcgcggtaatccctctcaataatgtccttctctatctcttccagactgcaatccacatttttttcctgcagttctttgtagcggcggatggccctgacacggctgcctgccgtcaggtaaacctttaaattggcgtcgggaagcacgcaggttccaatatccctgccgtccatcaccacatcttttctctgcgcaagcttcctctggagctccaccagtttcctcctgacaggcgcataaaccgacgtggacgatgccatgttgcccacctcctcggttcttatgaggcttgtaacattttcaccatttaagatgatctgctgggcgccgtccttatattcgagggaaatctccacaccttcacaggctgcttcaatcgcccctgcatcgtctttatcaattccttttctgagaaaatataaggccatggccctgtacattgctcctgtatccacataaatataaccgagattttttgcaagctgctttgcaaccgtgcttttgcccgcgccggcaggcccgtcaattgcgatattaaacggcataatccgtcttcctccctgtactttagtcgctgctgtccacactgcagcctttattgatggcggtgacctgtgcgcggagcgtgcaggttatcgttcgttacggttctcagcctgccaaaaacgcagttctgtgaacggtaacagcaacctttaatcctccccagccgcgcttcttcccgccaggactccggtcgaccatgcaatctgcagattgaagccgcccgtcacggcatccagatccagaacctcccctgcaaaatacagttttttaagaagcttcgactccatcgtggatggatttacctctttaaccgtaatcccgccctgggtaatgatagcctcgttgaagccgcggagaccgtttatcgtcagggtaaagcttttcaccgcttccacgagcctcttgcgctcttctctggttatctcattaacctgtttctccggcgaaataccgcttctttctatcattaccggaatcagcttcgagggaagcagatggttcagcgcattcttatactgcctgttcttcgcctcgtcaaagtcccggagaatcctggcatccagctgttctgccgaaagcgccggcttcagatcgatagaaagtgtgacgtttccttttttaagccgcttcgcaatatagctgctggcgctgagaagcacaggacccgaaacgccgaaatgggtgaacagcatctccccgaaatcccggtacaattccttttttccatcccttatgacgacctccacattcctgagcgaaagcccctgcaagtccttaaccactgtctcttccgtggtaaaaggaaccagggccgggattgtcccggtcacgctgtggcccgcctcttttgcaaagcggtacccgtctccggttgaaccggtggtcggataagagaggcctcccgtcgcaacgataacggccgaggccgcttcctttttggccccccgctccagaatcacgccttttaaggcgccctcctccagccatagctcctttacgccttcattcaggcggatatccacatccagggcccgcaatcttttcgaaagggcgcttatgacatccgaggatttatcggatacggggaaaacgcggcctccgcgttccgtcttcagacggcagcccgcatcctccagaagctccataatatccgtattcgtgaagccgtagaacgcgctgtataaaaagcgcttgtttgtgacaacaccggcaaacagctgatccatatcgcagttgttcgtcacattacagcggccttttccggtgatgtaaagcttcttccccagtttttcattcttttcatatataactgctttttttccgcattcagcggcggcgatagccgctgcaattcctgccgccccgccgccgattataataattttatccataccggtaattcaatccgggcagactgcccgctccttcatcaagtgaataacaatagtaggatactatgaattgcgttctttttcaacctcttttattttttcctccagcgcttccactacggttctgagaactttcacccgggcataatacttggaattcccctccacaatcgtccacggcgcgtaggtggtggaggtccgcaccagcatctcgttgacagccgcctcataggcatcccatttctccctgttcctccaatcctcatcggtaattttccactgcttggccggatcgttcattctttcgttaaagcgccgctcctgttcatccttatcgatatggagccagaatttcagaaccacagccccgaagttcgccatatgagactccatctcattaatctcctggtatgccctgcgccagtcctcctctttgcagaagccttcaatccgctccaccatgacgcgtccgtaccaggtcctgtcaaagatggcaatatggccggccttcggcatgttgttccagaaacgccacagatagtggtgtaccttttcaatatcattcggcgcagccgtgggatttaccttgtaacctctcggatccagatggctggtcagccgcttgatggctccgccttttccggctgcgtcccatccctcaaaaccaatcactaccggtatcctcagccggtagatttcactgtggagatactccagttttttctgcagcttatccacctgctgcttatactcctccttgtcgatggacagggacagatcgactccggacagcaccccgttcttaaaccgatcctgaggcatggcggcagagggagcatttcctgcctccttcttttcctcttcccgtttatgcacttcatattccatacggtcggccacggtcgccaggattttcatagccgcataattcttgtcggtggcctcaattattgtccaaggcgcatatcccgtatcggtatgctcaagcatctcctcattcatcatcaggtatttctcatactctttgttccgtttccagtccccgtcggaaacacgccacttcgtctccttattctccgtcagcttttcaaagcgttttttctgttccttctgggaaatgtagagaaacagcttgattatcacacagccgtcctccgccaattgtttttcaaacgaagtgatatcggcaaaagcgcctgacagttccccgcgtttcgtaattttatcaaaacggtcgaccgtcactttatcataccagctcctgtcaaatatagctatacggccgtcctccggcgttttcgtccaatagcgccacaggaaaggacgcatccgctcttcctcgcccggcctcctgctggcatatacgtcaaaacctctgggatccagcggctggatcaggcggttgatctgcacaccctttccggctgctcccagcccttcaaagacgattattaccgggatcttttcggccttgcatcgtctctgcaaaagccccaggcgctctcccagctcttcgctgacctgtctgtaagtctccttgtcaaccgttttctgcaaatccaccttttccagcataactttcctccatttccaggccgcgcgctcaatctgagacgttctccctgtctgctgccgtcattgcttcatgttccttttttatctcatggtacagatgtaccgaatcccaatctttattcacagatgtcagaaccgccttataatcaatacgtccgacacccttttttcgcagcgtcctgataaaggaatcgacctgggaggatgtaagtcctgcaagcaccgccatctcgtcatcaaaatcactgcacagcccgtctccggaatggtcagcctcggtaagctcctccattcccttcaccccggcgagagtcccaagcggctttccgtagtcttccctgcccaccgtctttacccggaatcctaaaggcagaagcgcctgcctgattttcatcagcctgtccttatcattaaaattgtaaagaagtactgtttctttcattattatatctccttctttaaatcgcttcagaacaaggtcaattgctcgtactgatagtttttcttatatgaatgaattatatccggcattttgtataaaataccggctttgctgcattcctcccccagaagcctgtacaggctcccggctttcggactgctgcatacatagcgttcaccgtactgtttttcataccgttcacgaactcccatatccgggaaaatccggtcaagccggctgtaaaaatactctctctgccggttccttaaagtcacgccgaacatggggtagataaatctggctcccgcttccctggcaagctccaccattcccataacattctccttcgtgtcttccagaaacggaagcacaggcgtcattacaactccggcaaacagccctgccgcggagaggttcctgactgcggcaaatctctctgaggatggaggcgcacccggttccagcttttttgacagggaatcctcacaggttgtgatggtgagcatacagtttacaggagcctgttccgctattatctgatatattggtatatctcttaatatccccgtgcttttggtcagcatggatacgccgaaaccaaaggctgcgataagctccaggctgtgtctcgtaagctccatatgaatttcatggggattatatgggtcactcatggctccggcgcctaccactcctttttttaccttgcggcgtaaatcatcccgtacaatctgaagcgcattttctttagcctttatctgttcaaaatcgtcgacacggtagcagctgcttctgctgtcgcaatagatacagccatggctgcagccacggtacagattcatattataatcacttccaaaccaggacgtgtctctattcttagtaataatcgtttttgccggaatcagttccattcctccgcgcctttctggctgtttttacaagggccgcccgtctttgcagggcttttgcccggacaaacgccgttcactctcttcgcacctgccatccgcaggaattctctcatggccgctgtgatatattttccttttttgctggcaaacaccaccttgcggctggccagcggatcgccaatcttataatataccagcttcttgttttccggaaggcagccgataatatcggaacggataaatacggctccgacaccgttggaagcaatattcatagacgtgagaacctggtccatctgaattgccacctttggcgtaaatccggcatttcggcacatgctgaaacccctctgatacatatcattacccggtttcatgataataaacggcgtatccttaaacagttcaagcggtaccggctcataggagtctgcctggaaacggtccgacacgacatcctgataggaaagccggtatggctggagcctcttgttgatcgcataagaggcgggcaccatcaggattatctcttcatttttataaaagaaccgctctactgtggaatcttcatagagcgctgtttcaatgaccagatccagtgtttcgtcttccagcccctccttcagttctttgacattcccctcgagcagatcaattgtcacattgggatacttctccctgaaacggccaatcagatccggaaagacaaaggaacagaaaaacgaggctccgcctatagaaagggaacctgtgttcagttcacgcaaatctttgaaatatgcctgcatgttccgctggataaacaaaatttcttcaatcgatttaatataatatgcgccctctttcgtgaccgtaagcggtatcgtgctgcggtcaaaaatgggcgcacctatctcattctccgccttgcgcaccatgttgctcagtgcaggctggctgataaaaagttttttcgctgcttttgaaaagcttttttcctgatataccgaatacacatacctcatctcattcagcaaataaattccctccgtccgttatatgtatctcacgatggacagcatagcgagtacactctccccctgattatcctgaacccacccattaccaaaaacagaaagccgcctccggccgcgccggaagcagactttctattaccggatcttcattatcccctgtttttagtttaccactatttttcttcacaggcaaataacttttccatttttttacattccttaccatccagcgggaagaagcttgaatgctccgagaattgcatatacgatagtaccgctgtaaagaagaataataatcccctgaataaatgagttatacatccagccgcagttccaatccggctcgatctctcctttttttcttgcccctttcagcataaaaatcggaaggattgccataattgcccctgcaaatgtgccggaaaagtaaatcgcatcaacgaatccgactgctccgctgagtgtcagcgccagcggaatgccaacaatcacgattgtaatcggaaggcggattttgacatcttcatccgaatggaatttaaatttatctacaatgttcgaaagaagagtctgggaaatcgcccagtaggaggtaagcattgcaatcagtgcgaaaatattggcgatataaagcgcccataatcccagggaacgtccccatgcaatcgttgcaacctgcgtcagatcctcagccggtgtgatatacataacgcccatcggaacaataattaaaagaacgcatacgatcaactgtccgagcgcgatggccggagccagctttttcggatcatgtgacagtcccctggccaaatcgggtaccaggtactgccctatgtaactgaatgcggcaacgttgaaaatcggaattgcatacgtccagttgctttggaaaattcttgataaatctccatttttcgcaatcatggaggctgcagtcagcaccaccagcataacgatcattccgatgctcatcagtttattgccgacacccatagcctttaatccgaaccaggcgacacctgcagccggaataaggaaaatcaaagttccaacccagtccggcacgcccagaagctcatttaaaatgttgccgcttcctgaaaaataggcaatcatgcagctcagggaattaattactaccgcaataaatatcaggatggagcctgctggccccagataccgttccgccagtccgggaagctgcaccagtgttctcgtcctgagcgtagtctctgccacatacatcatggaaaacagagtcaggataccggtaacgatgaaccagaataccagtaccggaagaccggccagtctggccgaatatgccgtccccaggcatcccgaaccaataccgcagcctacgaccgaaaaaacgacctccgcctgagtcagtttatggatttttaacgcgccctcctcatatttgggctgcgtcccttcttttttttcattttcccccataacaaactcctccgctcctaatatttttcaactgcgtccatcgagaaggtatcttccttgaaatcgttgaaatatggaatacggcttctcaccttcagcacctcattcatgtcaatgtcacaaacgagcagttcctcctctgtcttggaagcttccgccctcacttcgccgtccggtcccacaatctttgatgttccgcagcaattgtcctccaccggatttgaacctgccataaacatcaggttaaataaggcgttgccggccagatccacatcccatctgcgtgcagccggaatgctccataccgccgaacagaatacgagttccgctcctttgagcgcttcaatcctggacggctccgggaattccacatcatagcagattaacatgcctatcttgccgaattttgtattgattaccggaaaggaatctccctcacagaatttaagcttctccgtaccccaggcattcacttttctcatgtttccaatcacgctgccgttatcatcgatgaaaatacaggaattatacatttttcccggaatatgtaccgattctgcgtagcctgcaatgatgtgcatcccctttgacttcgcacattttctcattgtctggacaaaaggtccgtcaaccggctcagccagtttctgaagctcttccgactcaaggaaatagcctgtgtacgccagctccgggaagcagataatatccacattctgttccgccgcctggtcaatcatctccatcattttgcgcaaattttctttggtatcgccctgaactaccttcatctgtccgagtgcgatcctgacttttctgtcttgtcccattttcctcttctcctttttctttatctttttctgtcttacggtccctttcatatgaaactattccccataccgtatacatttattttttctattttacatagctgaaaaatggttttcacctgttatacagatttctaaataagttataacccctttgttataactgttattaatgctgcagagattatgtccgccggtgtttaaacgtcttcaaaaagggcgcctctttccggaagcgcccctgaaacaaaatattatcccctgttatttctattcttcacccaggcagaccatcttgccgtcttttacgattaactggccgtcaaaggtaatggtcgggttgtactgcaccatgtcgatatgtacggtagagcgtgccggctggccgtagtagaagccgttgcccattgcgatatggcaggttccccttgccttcttctcttcctcaaagtctccgttgaacatgcaggccggatttaatccgattccgatctccgcaatgttgtcgctgtcttttacttccgctatctgacggcggatttctttacaaatctttgcgtctccgcccactacctctacgatgcgtccgccttcaatcttaagctctaccggtacggtcgggcagccatagtagcagattggtccgtcgattacgagctttccgtgggtggttccgatgaccggccctaaggatacttcgccgtccgaccatgccattgcgtctccaggattgcgggcaatgccgcactcgatgattggttccatatcgttcatctccatgtacaggtcggttccggccggagttgtgatatgggcgttcttcttgcctctccagactgcctgcagttttacgccgtccgcatagactgcctcatagtcggctaaagctccgcctcttgtaaagttgtcgatgtgtcttaagcagatggatacttcacgcagcttcttctcattcataagctcttttaagcggttgttgtagatagccgcgccggatgccgttgtcatacctacgaatacatcacaggcctccatcgccagctccagtgtcttcgggaaaatcgtcgccttgtcttttccgcggattggcatcatgcttacattgtactcggctccgcacatcagggctgccgcagccatggcattcgccatacgcatgtcggtctgcgggtcaatggcaatcaggacttcctcgcccggttttactgccatcaggtttgataaaatatagtgcgccctctcgatacattcaataattctgttgtcttccataaatttttctccttttccttaatatgatttgtaatatagtttcaagctctcatccggcttccggcgtctctgtctacgccgcgccctttttttcatccattctgttaaatgtatcgcgatccagctcaccctcaatagcagagatacatactgccgttaccaaatcaccgacagagttggtagaagtatgaatctggtcgataattctgtatataccggctaccagcgcatatgcttccagaggaaggcccatctgtgtcagcagcgtaaggctgataacaaggccgatctgcggcgttgccgcacagcctacacttaagaaggtagcctgcacaaccagcataatctgctgctgaatacttagatcaatgccgtaaagctgcgctgcaaacaatacgatgataccaaaatagatacaggttccgttcatattggcggtagctcccagtggaagcacaaagcttgcgatgtcctttggcacgcccatcttcttcggcgcaacctccatggaaaccggaagagctgcggaggaagtacaggtactgaatgcgatcatccagggctcaaatgctttcttccagaatttcagcggactcaccttggcaatccccaccaggaagatcgaatagaccacaacgcacatgataatactggacagatagtccgttaaaataaatttcagaaccggcccgaatattgccacgccgtattttgccagagagacagacatcagtccgaatacgccgaagggaataattccaagtaccatattgacaatcttaaacatggtctgggaacaaagagagataacatcggccagcggctttgccgaatctccgatgctgataatcgcaaaaccgacaaacagagaaaatacgatgataggcatcatatctccattggtcagcgctgcaaaaggattactgggaagcagatccagaatggtctggtaaacccccggcagttccttgacctccaccgtgttttcaatggttccgagaataagtcctttgcccggctgaatcagattggccagaacaagaccaatggtagctgcaatgcctgagctgactaaaaaccataaaatagtcttgattccgatacttctcagttttttgatatcccccagcgaaagcgctgcatcaataatacagaaaaacaccagcggaacaacgatcattttgattaacttgatgaagaaatcgccaagaaattgcaggaacggcaaaatatgattattaattagcggattatccacccctcccataaaattcaaaatataaccaaaaataatacctgcaaacagtgcaataaaaatcttcacgtacaacggctgtttcttttttgttttcacttctcctttttgtcctgccatatggacccccttttaccagaagaacaatcaaccagtttccctttcctcatgaggatgtgctccattctagcagcttttcgtggtttattaaaaacttatataaaaatacgaataatctatatatttttagtaataacttacaattattttattaataaatatctccatataaaaataattactataaaatcaatatatttttcgttataaattaattagtttgtatattgttatttttttcattttcttatcacagacagatatcaaaatccggcaggcacgactccaatattaatccccgtttccaactagagcatatttgaatattgctttccgtcaaatctccctcgatgtggggcgggcagatggcgggaatgaattttcaaacacgctctaaaaaggaggcgcctgccgcaaagcatcgagcgcctcctctgttaaaacaggaagttaattattatttgcaattctttctattcttcacccagacaaaccatcttgccgtcttttacgattaactcgccgtcaaaggtaatggtcgggttgtactgcaccatgtcgatatgtacggtggaacgtgccggctggccgtagtagaagccgttgcccattgcgatatggcaggttccccttgccttcttctcttcctcaaagtctccgttgaacatgcaggccgggtttaatccgattccgatctccgcaatgttgtcgctgtcttttacttccgctatctgacggcggatttctttacaaatctttgcgtctccgcccactacctctacgatgcgtccgccttcaatcttaagctctacaggaatggtcgggcagccatagtagcagattggtccgtcgattacgagttttccgtgggtggttccgatgaccggccctaaggatacttcgccgtccgaccatgccattgcatcaccaggattacgggcaataccgcactcgatgattggttccatatcgttcatctccatgtacaggtcggttccggccggagttgtaatatgggcgttcttcttgcctctccagattgcctgcagttttacgccgtccgcatagactgcctcatagtcggctaaggctccgcctcttgtaaagttgtcgatgtgtcttaagcagatggatacttcacgcagcttcttctcattcataagctcttttaagcggttgttgtagatagccgcgccggatgccgttgtcatacctacgaatacatcacaggcctccattgccagctccagggttttcgggaaaatcgtcgctttgtcttttccgcggattggcatcatgcttacattgtactcggctccgcacatcagggctgctgcagccatggcattcgccatacgcatgtctgtctgcgggtcaatggcaatcaggacttcctcacccggttttactgccatcaggtttgataaaatatagtgcgctctctcgatacattcaataattctgttgtcttccattgttattctccttttcagttttcagatttactcctggtttcgtctggagcagaacctttgtctctgtttcagaacctgaatatattgtaataatttccgcactgtttttcattcgttatacgcttttttctatggcatatcactgtttagttatacgtctttaaccccggataaaagctctgccaaaagccggtctgcctgccgttgtgccgtcttaaggatttcctccggatcattgccgtatatgtcaagcccctcggcttccactgaatcgaaacgggcgattccaagcatctgacagaacgcctttagatacttcacggccaggttcggataaccggaaggcatcacgccggtataacctcccctggtcgtcacgtagatcatccgtgaagcgcggcagtcccccaccgtctcccccttttcattgtaatggaacgtcatttggctgacgcacatgcgctccagataaacgcgcagaagacttggaaaggaaaaatcccaaaacggcgccgctatgataataatatctgccgaagcaaactgccttgtcgcaccgaaaaagggatcctcaaagcagccttccgataccagcctgtttcttagctccacttcaccggcgtttagcggagtcagattacactccataagcctcaccgtctctacgttgaggtatggcctgccgccaagtccgtccacaagccgggcggccagcctccttgtacgtgattcatcgcctcttatacagcagtcaacatacaaaattcttttcattactttccttctcccctcattaatactccttaacgggcggtgaaaagcaaactgcacctgcttttcaccgcccgcggagactctttcttcctctttctttattcctcttcctttttttccacccctgccattttcataaattccctcatggcggaggtcgtgtattttcccttctttatcgcaaagctcaccggccgcgttgccagcgggtcaccgattttatagtaggtcagcatctcattctccggcatacagcttacgatgtccgaacggataaatacggctcccacaccgttagaagcaatatttacggatgtaagaacctgatccaccaataagactgtgttcatggtaaagccggcattcctgcaaatctggctgcttctctgatacatatcattgccgggtttcatcgtaataaacggcacctcccggagttcatacagaggaacctcttccgtctcactgtcggcaaatctgcctgtgagaatatcctgatacgaaagacggtaaggctggagccgcttattcacctgataccgggtaggaacggccagaatgattttctcatgattataaaaaaaacgttcaatatttgaccctacgtcagttgccgtctctattaccagatcgaccgtttcattttcaagtccttcccgtaattcgcctacatttccttccatcaagttgatgaccacattgggatacttttcccgaaatctgcctatcaggcctggaaatacaaaggagcagaaaaatgaagaaccgcccagggaaagattgccggtattcaggtttttcaaatccatgaaatacgacttgagatttctctggataaacatgatatcttcaattgacttaatataaaatgcgccctccctggtgacggtcaccggtattgtgctccggtcaaaaataataacccctatgtccttttccactttccgcaccattttgctgagagccggctgactgacctgtagctttcttgccgcttttgaaaagcttttctcctgataaacggcatatacgtatttcatctcattaagcaaataatttcccccagtcctgctgttttgtcactcgatatcatgaataccaaaagacaggtccgatttggttcttaacttcttcagacctgtctcttaaatcaagctgcctgtcctttttttctgactaactgcattccggccagcactgcaaacagtgcaattccgatcagatccgttacattccccgcatcgaccattaaaacgccgcagataaccagcagcacactctcccaccatttacacggtgcgataaagtaccgggtaaagcctgtggcaatccctatcatgccgataattgccgtaataattgccttcgccaccatcaaaataaagtatggcgtgctccagcccggattgactaaaaccagtaccggattcataacaaatatgtacggtaccagataagccgcaaatcccagccggaaagcattgaatcctgtcttcatcggattcgccttggctattccggcgcctgcaaaggcggccagcgcaaccggaggcgtgatatcggccacgattccgaaatagaatacgaacatatgggctgcaatcgccggaacaccaagagctaccagagccggtgcggagatcgtcgcctgtatgatataattggctgtcgtaggcactcccattcccagtatcagagaacacagcatcgtgaataccatcgtgagaatcaggcttccgcccgccagctccacaatgccgttcgccatcttaagtcccaggcctgtcgctgtcacgacaccgacaataatgccggcgcagccgcaggttactgctactgatatagcgcctctggccgtctcttccagacagagaacaaactttttcaaaaattccagaacattaaaccgcttagtctcacgcactatctcaatcacccagataatcaggcatgagataattccgtacatggccgcgttcatcgccgaccgccccataaccagcagcgctacgataacgatgataggcgctaccctgtaccagcctgttttcagcagatatacaacctccggcctatgttccttcggtatccccagcaggccgtttttcaccgcttcaaaatgtacattggtaaaaataccggtaaaatacagaagcgccggtatacaggccgccagggcaatggttccatagttggttcctacgtattccgtcataataaatgcggccgctcccataatcggaggcattatctggcctccggtagaggctgccgcctctaccgctcctgcaaattcaggcctatagccggattttttcatcaacgggattgtaatcgaaccggtgcttaccgtattcgccaccgagctgccgcttatggtaccctgcaaagcgctggctacaacagctgctttcgcaggacctcccacacttccgccgcaggcgcccatggccagccctgtcatccagtctcccacgccgctggccttcaaaaatgtggcaaaggccagaaacaggaaaataaacgacgaggaaacgtagattggcgaacccaggattccttcggttcccagccattccaggcagactaaccgcttcagcgtcatgcctctgtggaaaaggaagcccggaaggtaattgccgaacagggcatataaaaggaacacgctgccgacacagacgattaccagcccggccacgcgccgcgccgcttccagcagcagcaggatggctaaagcactaatcaccatatctgccgtggtaaagcggcctgcccgcagaagcagctgatcataaaatactatatggtaggcagagcaggcaaatgccagcgctgcaagaatataatcataaaacgggatcttatcgctcggctttccgttcatcggataaagcaggtaagccagaaccattgcagctcccacgtggggggccctttgcagggtggaaggaaaggttccgaaaagacccgtataaagctgaaagacggaccatgccaccgcaatgacaaatactatttttgccggagttccgctcaggcggcggaacttcgactctttgtcaaatttggtcatgacttcttcgctgctgacttcctgttcatctagcttaatggttgtgtcttctttatacattcctacctcctgtacctaaatgccgcactcaaagtgtcattacattcaactgcaggaatttaatcgatcagaaggccgggatcaacagttatgcctttttcttcataataacgcgccgcgccggggtgaactgcggtagtaattccggaaagtccaccctccaggctgatatctttaccggccgggtgcgctgctgcgatctcttccgcactttcataaaatgcttttgttatattataaacagtgtcatcatccagatccgaacggcagtacagcacggcctgacatgtaatcgtctggaaatcctcggtattgctgtaggtccccgccggaatcaccattttctcaaagtacggagcttccgcctgaatcttcgcaatctcctcatcgctgacgctgacataagacagctccgtggatgtcgtcatctctacaatagatgaagccggtacattaagaactgcacaggatgcatcaatatgtccgtcctgcatcttaacagcggcgtcgccgaacccatcctgctgcggctggatatctttattgatatcaaggccggccgctttgaaaaccaggtccgacgttccggccgttcctgagccggtaggtccgatagctactttcagtcctttcaggtctgtaactgatttggcattcgtacttgcattggcaacgatctggtatacctcatgataaacaacgccgatggcacggaagctcttaatctcgcctgtatccgcaaaggcattacggccgttccacgcatcatccgccgtagcattcatcgcgatgccgaggtcaaattcgccaatgtccatcatattaatattttccaccgaagcgccgctggcctgggaatccagggacagcccctccagtctcttgttcatcgcgctggccatagcaccgcccagggcaaaataagttcctccggaagagccgcttcccatgataagcgctactgttttgccgctgggagcagccggctgtgcggtttcactacctgcaggctgttcctgctgtgtttctttgccgtccgccgaagccgcaggctcggttttggaactgcaggctgtcgccgtgaatataagaatcatcgccagggtgatgctcaaaattttcttaatttttttcatacactgtcctcctcttttgtaatgtggctatatcttgtccgaagcttgcggtgcttactcttcgcccaggcagaccatcttgccgtcttttacaatcagctcgccgtcaaaggtgatggtcgggttgtactgcaccatgtcgatatgtacggtggaacgtgccggctggccgtagtagaaaccgttgcccattgcgatatggcaggttccccttgccttcttctcttcctcaaaatctccgttgaacatgcaggccgggtttaatccgattccgatctccgcgatgttgtcgctgtcttttacttccgctatctgacggcggatttctttacaaatcttcgggtctccgcccatcacctctacgatgcgtccttcttcaattttaagttctacggggattgtcgggcagccatagtagcagattggtccgtcgattacgagttttccgtgagtggttccgatgaccggtcctaaggatacttcgccgtccgaccatgccattgcgtctccaggattccgcgcaatgccgcactcgatgattggttccatgtcgttcatttccatatacaggtcggttccggccggagttgtgatatgggcgttctttttgcctctccagattgcctgcagttttacgccgtccgcataaaccgcctcgtaatcagctaaggctccgcctcttgtgaagttgtcgatgtgtcttaagcagatggatacttcgcgcagctttttctcattcataagctcttttaaacggttattgtagatagcagctccggatgccgtcgtcatacctacgaatacatcgcaggcctccatcgccagctccagtgtcttcgggaaaatcgtcgccttgtcttttccgcggattggcatcatgcttacattatactctgctccgcacatcagggctgccgcagccatggcattcgccatacgcatgtcggtctgtgggtcaatggcaataagaacctcttcacccggcttcactgccatcaggtttgataagatgtagtgcgctctttcgatacattcgatgattctgttgtcttccatagtctctccttttcttgaagtgatgtgagttacagttacagttactgccggaaatctccggcgtttctataaaaacagttttaccactgtccttatctattccacttctttattcgacaattcaggcaaaaatcaatatagtatctgttataattttatcatgatgttaattttccataaattactatgtctttttatgaatgaggtataaccattttgttatatcttaaggttctatactgaatgttggggtgtgctgaaaagcacacttccaacattcttttcgttgtaataaaatacatctataagaagcctcctaaacgcattatcccgaccaaagtttaatgttacggaggtgaccccttatagatgtaccctaattataccaaggctttccttaacttggaaggtgtttctattaaaaaagtggttcaggcagactctttcattaaaattttcatccagtcccaaccggtagaacagacttgtccctgctgtggggctaaaacaaaacggattcatgattaccgtttacaagaagtccaggacattcccttactgggaaaacaagtaatcctgctccttcgcaaacgccgctacctctgcccatactgccgcaaacggttcacggaaccctattcgttcctccccagctaccaccgcaggacccgcaggctggcattttacattgtctccctgctccggcagaccttttccttaaaacagatcgcagagcttaccggtgtttccgtccagacggtctgccgccttctggacacgatttgctatcctccgcctgaccagcttccacaagcgctttccattgacgaattcaaaggcaatgcttctaccggtaaatatcagtgcattctggttgatccgaaaaagcgccggatcctcgacattctcccggatcggacccaaagccatctggctgattattggcggaacattcccaggaaagaacgcctgaaggtaaagttcttcgtctgcgatatgtggcgcccctacaccgaacttgcacagaccttctttccaaacgctacaatcatcgtggataaatatcatttcatccggcaggtgacatgggcgattgaaaatgtacgcaaacggctgcagcggtccatgccggtttctctgcgtaagtattataaacgcagccggaaactcattctgacccgctacaaaaagctgaaggatgagaacaaacaggcctgtgatttaatgcttcactataacgaggatctgcgtctggcacaccgtatgaaagagtggttctatgatatctgccagatggaagcgtatcgtcagcagcagagggaatttgatgactggattgcgaatgcacagagctgtgggatcaaggaatttgaggcctgtgctaagacctacagggcctggcgaaaagaaatcctgaatgcctttaaatacgggctgacaaatggtcccacagaaggatttaacaacaagataaaggtattaaaacggagcagctacggaatccggaatttcaaacggttccgaacccggatacttcactgtacatcataggataaaaaggtcggtaatgcggaggcttatttggcatgcccaaaatcagtaaaacctggaactaaacataaaaagggcccttttcatagaattggggcgggattttaacaaatcccaccccaactattgacaaagagcctatcttaaaaaggcggtgaaaagtcagccttcacaacttttcaccgccgtaattcaaataaacttaattcaatttttgttcaattattcttcgcccagacaaaccatcttgccgtcttttacgattaactcgccgtcaaaggtaatggtcgggttgtactgcaccatgtcgatatgtacggtggagcgtgccggctggccgtagtagaaaccgttgcccattgcgatatggcaggttccccttgccttcttctcttcctcaaagtctccgttgaacatgcaggccgggtttaatccgattccgatctccgcaatgttgtcgctgtcttttacttccgctatctgacggcggatttctttacaaatctttgcgtctccgcccactacctctacgatgcgtccgccttcaatcttaagctctaccggtacggtcgggcagccatagtagcagattggtccgtcgattacgagctttccgtgggtggtcccgataaccggccctaaggatacttcgccgtccgaccatgccattgcgtcaccaggattacgggcaataccgcactcgatgattggttccatatcgttcatctccatgtacaggtcggttccggccggagttgtgatatgggcgttcttcttgcctctccagattgcctgcagttttacgccgtccgcatagactgcctcatagtcggctaaagctccgcctcttgtaaagttgtcgatgtgtcttaagcagatggatacttcacgcagcttcttctcattcataagctcttttaagcggttgttgtagatagccgcgccggatgccgtcgtcatacctacgaatacatcacaggcctccattgccagctccagggttttcgggaaaatcgttgctttgtcttttccgcggattggcatcatgcttacattgtactcggctccgcacatcagggctgccgcagccatggcattcgccatacgcatgtcggtctgcgggtcaatggcaatcaggacttcctcgcccggttttactgccatcaggtttgataaaatatagtgcgctctctcgatacattcaataattctgttgtcttccattcttcttctccttttctttgaacatgctactaattgttaaattgacagtttctttatctttttatttctaatgcgtttaaaataccatccaaagctcacattcttaagactttttaagctgcgctttttccatcacccatatcgttgaatttatcgcggtcaagctcaccctgaagcgcagagatacatacggcagttacaaggtcgccagcggagttggtggatgtatgggcctggtcgatgattctgtagataccggctaccagagcatatgcttccagtggaagtcccatctgtgtaagaagcgtaaggctgataacaaggccaatctgcggagttgccgcacagcctacacttaagaaggtagcctgtacaaccagcataatctgctgtgaaacgcttaaatcaatgccgtaaagctgggctgcaaataatacgatgataccaaagtaaatacatgtaccgttcatgttggccgtagcgccgagcggaagcacgaagctggcaatatccttcggtacgcccatctttttaggagctacttccatggaaaccggaagtgctgctgaagatgtacaggtactgaatgcgatcatccacggttcaaatgccttcttccagaattttatcggacttaccttggctatgaaaataaggaatatggaataaaccaccacacacatgataatacttgccagatagtcggttaagataaatttcagaaccggtccgaaaattgcgaggccgtatttagccagtgatacggacataaggccgaatacaccgaatggaatgattccgagaatcatgttaacaatcttgaacattgcctgggaacagactgatataacgtcggccagaggttttgccgcatcgccgatactgataatcgcaaagcccaggaacagggaaaatacgataattggcatcatgtccccatttgtcagggatgcgaacggattgcttggaagaaggtccaggattgtctggtaaacaccgggaagctcttttacttcgaccgtattctcaatcgtgccaaggataagtcctttaccaggctgaatgatatttgccagaacaagaccgatcgttgctgcgatgcctgaactgaacaggaaccacaaaattgttttcacaccgatgcttctgagttttttgatgtcccccagcgaaagcgccgcatcaataatacagaagaaaaccagcggaacaactatcattttgattaattttatgaagaagtctcccagaaattggagaaatggtaatatgtactcattgataaccggattctctaccccacccataaaattcagtatgtacccgaaaataatacctgcaaacagtgcaatgaaaattttcacatacagaggctgtttctttttttccttaacccctcctgttgtttgtgctgccatattagtcccccttttttgtaataaatgattaactagtttccctttcctcatgaggtttgaacatattttatcaagctgttaacgcattataaactgttatacaagatccgaaatataatatagttttttagttatatgttaagacagtgttaaaaaagggcaaaaaaaggccgggaaatgtatgggatgttgtcgaataatcccttgcactttcccggcctacataaagtcccgagcacgtcctgcgtatattctattccgtcctgtaatcccttgccgcatcggcaagctgctgcaaaaccccctcatcgagatccgcaaaatacggtatgttttctctctgcctgtccgcttcctccatatcgaggtccgcaaacacaagctcttcctcctgtcccggcgactgggctatcattctgccgtcaggcccggcaactccggaagccccgcagcaaagctcgtccgcaaaattggctcctgccgtaaaaagaagattgtacaggctgcttcccttcaaatccagatcccaccggttcctggccggaacgctccacgccgccggacaaaatatcatccttgcccctttaagcgcagcaatccgggccggctccggaaattccaaatcatagcagatcaaaatggccgccctgccaaattccgtctcaaaaacaggaaattcctctccctgcttaaatctctttttttcacttttccaaagatatacctttcttgcttttccggcaatttttccctgcctgtccgcaaaaaacgccgtattatagatatcattcgagtctccccgctcggcgaacccggctacgatacagatcccgttcttttttgccgcttcacagattccccggacaaattccccgtcctccctctctgcgatttccaaaagcctgtcttttttcacaaaataccctgtatacgataactccggaaaacaaatgatatcggcccctcctgccgctgctccggccgccatcgcctccatcttcttcatgttggcccgcgtgtccccctgcacggcccgcatctgccccagtgcaattcttacattcctcatcttctcactccattgtcatttttatgccgtacagaaagtataacatatcactcccgagtcggcaatgaggaatacacaaagcaaaaaccccgaaaccatattccgtttcagggttttcacataatccagtctgtagttgctctcacgttttccatagtctctcccattaaattcccagtaacctgcggaattttacgtctgcctccttttcgtctgctccgtcaaagtagaatatcaggaacttcttctgcggctgtattcccctttgcagttcgtcgtaactcttaacattaatcttcttctgctccgcctttatatatatgtcacatccaaacaaattagctgcctggattaatgcagatatcggcggcggcgtatttctttcgtttcctgccaaattgtactgtctggccagcataagcctccctccttccaaatattcgaggctgttaactatattcttataatttcactatatcacattccactaatctgtcaatacatatttacataattattatctattattaaacattatgacaattttttgtccaattgtttatacatattttatatttaataaaggagagcgcactgcgtgattctttcatatcacagactttgtttttatggtataatgaccgcgtagcgggcattataccgcgcatcaacggtttctgcgtccaccgcagaaatccggcgctaaaattaataaaataactaagcgaggcattacatatgaaatttttagaaaagcatcccatgtacatgattgcaaccggagtagttggaatatcactgtctgccattatagtaaagtattcagacgctccctctttgattactgctgtttaccgtcttttctttaccgttgccatgatgacaccggttgtatttttaaaccgcagtttcagaatggaactctcccgcgtttctctgcgaacggttgttctgtgcgctgtcagcggaatctttctggcgcttcactttgtcagctggtttgaatccctggcctacacgtccgtagccagttccaccgtaatcgtctgtaccgagtctatctgggtggcccttggcttctgttttctattaagaggacgcttaaagaaaaaggctgttttaagcattgccgtcacctttgccggcagcagcctgattgccatgtccgattacggctcgggcagcagccttctcaaaggcgatttacttgcactctttgccgccgtcatggtggccgcctatacgctgctcggccggattgtccgggcggatacttcaaccacggtttatacttatattgtatattttttctgcggcctgtcactatttgccgccgcgcttatcacccgcacaccgctcaccggttacggcagttcatccatgatctgcggtttactgctggcaatttgctccactctgctcggtcacagtgttttcagctggtgcctgaagtatctctctccggcctttgtatcctcttcaaagctgtgtgaacctccggtagcctctctgttactgtgaaactttaacttctgggaagccaaaaaagcgcagacttcccccatcaacctttttgacgtttattttgaactcagctaacaggttcaggcggcaactaccggaacctcccacccaagcgcttttaacttctttaggtacgcattaattttacgttccttgttgaattggttgtaataatcagcacccagatctttgaaaacaactccatccttgagtatgtgatagatggctataagcatggaatgggcaactgcaacataagcccgtttttttccacggtgggaactgattctcatgaactgcgcataaaagtacgaatttttatttcttgtagcggaatgcgcacagactaccagggttgaacgtaaaagagcattcccttttcgcatttttccggtcttcctcttttgggcactctcgttattgccgggacatagtcctgcccatgcagcaagatgaccggccgttggaaaacgactcatgtctgtaccaatcaccgaaataatggcctgggaactgttttttccgataccagttacatcctggattgcttgtgtcgcttttttttcttccggtttcataaagttatcaatctcatcttccagattgttgatatgaacattgagttcatccagatgggacagcagctctttcatcattcgacgttgtaatggggtcatgacaccatttaaatcatcgataagctgttccttgctggctttgagattgtgggcaatgattttctgtttatacatttcatcatactttgcttcgtcgaagaattctccggtgagaaggtattccagaatgttgcgcgcactcatgcagttgatgtcagatacagtaccggacagctttatgttggcaccctccagcatcttttggagtcggttcaattcccgggtgcgttcactcacgaggcttttccggtagcggaccagttcccttaactccctctgctgtttatccgggatataactggcttttaataatccgtgctgaagaagctccgcaatccattccgcatcctttgtatcggttttccgccccgggactgctttcatatggctggcattcaccaccatagcctttagttcagaagactcgaggatgttatacagaggcttccaataggacgctgtgctttccattgcgaccatttcacagccaccgttctgaagccagttagctaattcaagaagctctctggttgttgcaccaaagttccgtaactcctgcttgctgccttttctaaagcaggcgacgatgagctttttgtgcacgtcaataccacaacatttgtcgtaaactttatccatatggttacctccaaaataaaatttacggcacggtactctgtctattattattttactgtacgtccttctgccgcaagcggctggacagatggtggtgcaaatgagagtacctaaaatcagtttagcgaacgggctacaggcccaaattagtgccgatttttgccgttaatgtcagtataagctcaatcaacagcaatttcaatcacctgccgccctcgcagtttcatttatggtggtgccgcatcagaggcatgggggtttagcgatgatactcttcggagaaataccgtccctgctccagattttaggaggtattataattctggccggcgtaatttattattcgaggcttgaaaccgctgcctgagagcatgtttgcgaaccgtatcacgctcccaagcacgctcttcgagcttttcacgccgttcaatcaaagttttcgttcattttaggcctccgccttaatatgatagagtataaaccatcaaacggaggttctcatgagttcatacttatccgtatccggcgttatcacccggattcaaccgcttacaggagttaacagctcccagtacggctgtacattaaacatgtccatacgctcccttcaacagggagaagtaaatttcacagtaaccggcgatacttacgtggttgacaacacaacactgcatcctggcgatcaggtgactgtcttttacgacgggaatgcccctgcgccccttatatatccgccgcagtataaagcggttgtcatcgcgctctccgcttatcaccagtattatcttggagagttttataataattttgtcagtaccgacggaaccctccagttaaacggcatggcggcacagggtaccttccttcccaacggccagattttttccggcgctttagtcggaaaaacagcgcttgtcgaatacacctcctctacaagaagcattccggcccagacaactccggatcgtgtcattgtattttgttattcgtaaacccaggtcaaaaagatatcgcctaaatagaaaaacggttcgcaaaggtatcagcctctgcagaaccgttttcctattctcttctttctttattcccagcttctgttccatttcttaacccgctctcatgcgtccgtcattttcctgcgcattgtcagaaatctgccggcgcccgcatctaacaccttgattatagtctcgtccacaatgacagcgatcaggtatgacaccacgcatgtaaaaatataggggatgaccagctggccgatgcttttattctcccagccgacaggaataaatccgagcggaagaacggccgacaggacaaacagatgcaccatcaggacggaaaagcttcttttcccaagcctctcaaggatccgcgaaaagcggttgcatataccgttcaatctcagcaccaggacaaatacggctgaggccatcaaaaattcaagtatagaacaatttgcaataatctccaggtaatccggacggaagctgtatatccacagcgagaaggccaaggagaaagcgccccctgccgccagaaagatatcatatttcctcatccatgccttattcagtaaatatccgcccaggaacaatcccagccaggaatccagatacagagaaatccccaattcgaattgaaaatacgtacatgccgtccgtatcgccaacgccgccgcaatcatggcaaacagcagtttttccatccgttcaggcattttcgccagcatcaggcggtaaaagggtactaacagatacagcgccagcagcttgtaaatcagccataaatggggccccatcgtgatggatgcgccaaaaaagctgagggcggcctctccggcccagcctgccgttccctcgccggtggcacaaagaagctttaaataaaacagggaatataccgcaaacggcagcacaattttcacaactctttttctataatactggccgatggtttcttcccggtatggcagaagcagggccccgctgataaagaagaacagcaggttgcaggtcagcacagacaaaacaaccgcctgaaaaaagaaatctctcggcgtcccctttatctgggtcacggcaaccggctctaccacatgcactgcaattacaaacagtgccgcaagaacacgcacaccatccagataagccgttctctgcctccgctcccccggctgtccggccgctctgccatgggactgtttcgctcttttacgccgttctgcgccgtgcaggcaaaaagataacggcagaacggcagcaagcagcagaaggcgcaggggattcacccggtcaagcatctgccggacagcaggtcctgcagccggtctttcgttcacggatacattctttatctggccggcccctgtcaacgtcagcctcaatttctcacacctgacatcaggaagaggaatgattccctttgtcgttcccctcagcagccagcgctcaatccggcgaaaccggttaaactcctgtccgctgttttccgtatagtatacaagaacctgcatcttctcgggtatcggttccgtaaactcaaactccagatagccggcccggatgcccggtgcaaaatccagccagggcatgtcctccgttgtctggtacggattcccgtttgccgcttcgccggccgtatattccgggactaatacaatattttcttctaaaatagaaccgcgcctggctgaaaaataagccaggcacaattctatacatattgctgcgataagccctgtcacaatcagggtaaagcatctctttttattattcatcttccgtctttcagattaccatacaacaccgttggcatcaatccacttgccgttcggtgcctgtctgttgaaccacattgcgccggttgccgtatcaaagaaataccatttaccgtcgatcatctggtagctggtctttcttgcgcctctcgttccgtcggaaaccggattcagatagtaccataagccgtcaatctgctgccagcccgtcttcatagcgcctcttgttccgtcagatacaggattcaggtagaaccagttattatctacaaaaatccatccggtcatcatgtaaccgttgcctgccaggtagaaccagttattatctacaaagagccactgattcgtaagcggtactccgttattctgacggtacatccagccgatctgatcctgtacccatccgccgctgatggaaggtgttccggaagaaccgctgccggaagccggcggtgtgcctgtgtaaacattgctggagttcatatagtagtcatccgactcgtcactccactcgctcttctccccgtccgaattgctgatggctcttaccttgaaggagtaatcgcccgctttagtcatatacgggtagaaattgtatctttcattcgacgttgtaactgttgtcactgaagaaccattgcgatacagtttaacttcatacttatcagcgtcatcaatggtttcccatgtagcattcctgccgtcccattcaagttcatcgggaacctccagctcgccgcttaccttacgctgcttcacttcaaccctgagtcctcttccgctgtccagcctggatgcagatttgaattcgctccggttgcctgatacggaaaaatacttggaagaggtataggagaatctgtacttatctgctgcatctcctattaattccagctcgattctgataaccggagtctcgccgcgctcccactcatcgtcattggtattatggtactccacactgtctatccggaagtctgttccctccttgagattctgtgaaagagtgactttaaccgacggtgtgcctacactgtctccagcatccggcacttcactgttaacctgcaccttcacttttgtaatcttgtcttcggccgcataggcggtcatacacattgcgcatgcggttatcatcgccaatacaggcaccgccgctttcttcaggctacgtttcataaactttcctccttcatcctcttttaccttcgtatactgatttttttgtttgcatataccttattataccaaatgaattactgttcgtcaaagaatctctattctattttcagaaatttgacagtttttcattcatttattataataatttatatattttatctagctccgagaactttaaaattccgaaatttcggatgcgctcatatgacggttcagccatgatgcattccgcgaggtgttttcgctgtttttgcgaaaatcccgagttgtgcggcgcgatgcgatgaaaagcaaacttttcaccacaatcaacggcgttttttgccgtttctgtgcatcatctgctgcagtttggccgaaggctgaactgtaacgcgctcatcgagcagtacatcactaatccacaggaaaggaaccctaacccatgaatgattctaaaagccagaaaaacgaagttgtcaaaaacctttttgaaagaaaatcagtccggatattcgaagaccgtcccatttcaccggaagaccgcctcacaattcttcaggctgcctgccaggctcccaccgccggtaaccagcagctctatacaatccttgagattacagagccggccctgaaaaagcggctgtccgttacctgtgataatcagcccttcatagccgatgcgccgttggtgcttctgttctgcgccgactgccagaaatggtatgacgcttaccgttatgccggctgcacccccagacatccctccgcaggcgatctgatgcttgctgtcgaggacagttcccttgccgcccagaacgccgtcactgccgcctggagcctcggcatcggttcctgctatatcggagatatcatggaacactgtgaactccaccgggagctgtttcagcttcccccttacgtcttcccggccgtcatgctggtactcggctatccgactgcccggcagcgtgaaagaacaaaaccggcgcgctgtcctctggactccatcgtgatggagaatacctaccgtaaaatggaccgtgacgctctgtatcagatgttctcccataagtccggccaacagtcctatgaagactggatgtctgccttctgcaacagaaagtataattccgatttttccagggaaatgggacgttctgttagggaatatctgaaagagtttttgtcttctgatcaaacggaacaataaggtgttcgatcccggaatttcctttattggttttatagtgtaattatatcagactattgttacctatctctaactttttgcttacattttcattaaatagagatttagttaagcaggtgaggacgccgccggtacggccagcggacggggtggtggggtgtggatatgagtctttcgtcccgggggaagattatcgtggtgtggggctgcgggcgaagataaagtctgcggagcacgctcccgctctgtgaaatgcatcgcgctgctaagctcggcaggacctcgctaaacccccatgcctctgatgcggcaccaccataaatgaaactgcgagggcggcaggtgattgaaattgctgttgattgagcttatactgacattaacggcaaaaatcggcactaatttgggcctgtagcccgttcgctaaactgattttaggtactctcatttgcaccaccatctgtccagccgcttgcggcagaaggacgtacagtaaaataataatagacagagtaccgtgccgtaaattttattttggaggtaaccatatggataaagtttacgacaaatgttgtggtattgacgtgcacaaaaagctcatcgtcgcctgctttagaaaaggcagcaagcaggagttacggaactttggtgcaacaaccagagagcttcttgaattagctaactggcttcagaacggtggctgtgaaatggtcgcaatggaaagcacagcgtcctattggaagcctctgtataacatcctcgagtcttctgaactaaaggctatggtggtgaatgccagccatatgaaagcagtcccggggcggaaaaccgatacaaaggatgcggaatggattgcggagcttcttcagcacggattattaaaagccagttatatcccggataaacagcagagggagttaagggaactggtccgctaccggaaaagcctcgtgagtgaacgcacccgggaattgaaccgactccaaaagatgctggagggtgccaacataaagctgtccggtactgtatctgacatcaactgcatgagtgcgcgcaacattctggaataccttctcaccggagaattcttcgacgaagcaaagtatgatgaaatgtataaacagaaaatcattgcccacaatctcaaagccagcaaggaacagcttatcgatgatttaaatggtgtcatgaccccattacaacgtcgaatgatgaaagagctgctgtcccatctggctgaactcaatgttcatatcaacaatctggaagatgagattgataactttatgaaaccggaagaaaaaaaaagcgacacaagcaatccaggatgtaactggtatcggaaaaaacagttcccaggccattatttcggtgattggtacagacatgagtcgttttccaaccgccggtcatcttgctgcatgggcaggactatgtcccggcaataacgagagtgcccaaaagaggaagaccggaaaaatgcgaaaagggaatgctcttttacgttcaaccctggtagtctgtgcgcattccgctacaagaaataaaaattcgtacttttatgcgcagttcatgagaatcagttcccaccgtggaaaaaaacgggcttatgttgcagttgcccattccatgcttatagccatctatcacatactcaaggatggagttgttttcaaagatctgggtgctgattattacaaccaattcaacaaggaacgtaaaattaatgcgtacctaaagaagttaaaagcgcttgggtgggaggttccggtagttgccgcctgaacctgttagctgagttcaaaataaacgtcaaaaaggttgatgggggaagtctgcgcttttttggcttcccagaagttaaagtttcacagtaatcagcgatggatttaggcggcatccgcagcctttatcttcccctccgccccaaggccaggttttcgccgggacgaaagactccgccaagtgtatcggccccgtccactggcctgcggccgctgaatgtctcacgcgttaagtgcggggcggaccttgtcgcggccactaagagcttccgtgggcgggaaatacgatatgccttcgatgggtctattataaaaaattgtggaggatttgatatcagcctgccggaaacacgtagtggccgcgacagggccatccccatttaaggttggagataatcagcggcaggaacggaccatgtccggtgtcgcgaaaacctccgcctgagtcttccgtccctgcgataacctgaaccggggaagtaggcggaatcaattgcggaggggacatgggagtccgccggtgcttggcgaggttcctcacgagcttagcactgctgcgcactccaaagagtgcaaacggtccccgcagcaattcattccggccggattcccccctcacgacaaccttcaaccagggacggaagactcagtcatccccctcaccccaccggacatggtccgttccggacgcgtcctcccaacctcagttaaatctccatctaatcgaaaatgagcgaaatgaagaccgtttaaattcttccggtctccattccgctcatttaaatatacaatttcatataaacatcaagtataaatatatctgcggcaaggtacgcccccgggacgaaagactcgtatacacaccgcactgtccgccggccgtaccggcggcgtcctcacctgcttatttaaaatatttcacaccggattcaaatatcttcatatcctgctcaccgtaaatattcacagccacaccgtcgccgcgtctctccgaatggcccatcttaccatagatgcggccatccatgctggtaataccctcaattgccatatatgagccgttcggattccattcttcgtccatcgtcggattaccggccggatcgacatactgggttgctacctgcccgtttgcataaagtgtattgatccactcatcacttgccacaaaacggccctcaccatgtgaaagcgggttcacatagatgcctcccaactctgcttcccggagccagggggatttattcgatacaaccttcagatatgccattttggaaatatggcggccgatgttgttcatcgtcagtgtcggtgaatcggccttctgcggctcaattttttcacccgggagaagtccgagtttaagcagagcctggaatccgttgcaaacacctaaaatcagtccgtctctttcccccagcagcttctccatctcctcctgcatcactgcattcctgaatacggttgcaaagaatttagcggaaccgtccggctcgtcgccggcggagaaaccgcccgggaacataataatctgggaacggctgattgccttcctgtattcctcgatggaatcacggatatcggaagctcccctgttacaaaagactttgacaatcacatcggcgcctgcgcgttcaaacgccttggtactgtcgtattcgcagtttgtacccggcataaccggtataaatactgttggttttgccactttattcttacagatatggatggaatccgtcttaaacagttcattccttacctctgtctgttgaatacctgaacgggtcgggaataccttttcgagtgtgttagtccaggcattcagggcttcttccatcgtgattacggtattgccatattcaaatgtctctttatccgtcacttcaccgatcaccgtataggaaatggacagttcacccacttttccgtccggcacttcgcagacgatattaccccagcccggcgcgaagaagtcccgaggatctacattatgctcaattctgacaccaagtttattgccaaatgccattttgctgactgcctcggcggctccgtgtccctccaccgcataagcggaaataatcttccctgcttccatgtctttatagagcttgtcatagccgtccatcacctggctgtatacaggaagatcatactgatccttctctattgtgaaaagtacaatcttgcttccggctttcttaaactcgggtgaaaccacatgctgcttatcggatatatcaacggcaaaggataccagtgtcggcggtacattgatttcgccgtgttcctcgtcgttaaaggtgcctgacatgctgtcctttcctccgatggaaggaaggccgaagccaatctgcgcattataagcacccagcaatgcggagaatggggttccccagcgtttcggatcctctgtcatgcgcttaaagtactcctggaacgtgaaacggatcttcttgtagtccccgccgcccgcggcaatcttagctacggagtccagaactgcatagacggcgccgtggtatgggctccagctggagagatacggatcataaccatagctcatcatcgtaacggtatcacagctgcccttttccaccgggagctttgctatcattgactgtgtctccgtaagctggtatttaccgccgtaaggcatgaatacacttgctgcgccgatagaaccgtcaaacatctccacaaggcctttctgggagcagacatttaaaccggacagcatcttcagccatgtttcttttacatcgccgatttcttttttctcaaacagattgcctgtcctgaccggaacttccacagtgacggaagcttcctgatgggctccgtttgtatccagaaatgcacggcttaaatctacaatcgtctttcctctccagttcatcaccagtcttggcgactctgtcactacggctgccggaacggcctctaggttttcttccgccgcaaatgcaagcatcttatctacgtctttcgggtccaccactacagccattctttcctgggattcggagatcgcaatttccgtaccgtccaggccggcatacttcttcggaacagaatcaagatcaatcttaagtccgtcggccagctcgccgatggcaaccgatacgccgcccgcaccaaaatcgttacatttttttattaaagagctgacttccggacggcggaacagcctctgtaattttctttctgtaggaggatttcctttctgtacctcggctccgcacacctcaatggatgcctccgtatgtactttggaggatccggtagctccgccgattccgtcacggccggtgcggcctcccattaaaatgattacatcgcccggatctgaagtctcgcggattacattctttctgggcgcagctgccataacggcgccaatctccattctcttcgcaacataatcaggatggtaaatttcttttacatagccggttgccaggccaatctgatttccgtaggagctgtagccgtgtgcggcatccgtcacaatccgcttctgcggaagcttgccgtgaagtgtctcggacatcggcctggtgggatctgccgctcctgtcacacgcattgcctgatatacataggtacgccctgacagcggatcacggatggctccgccgagacatgtggcggccccgccaaaaggctcaatctccgtcggatggttatgtgtctcgttcttaaagttaacgagccactcctcttcctgtccgtcaatgacaacaggaaccacaatgctgcatgcgttaatctcttccgattcttccagatcctcgagttttccctctttgcgaagctttctcattgccatcagagccaagtccatcaggcagacaaacttatcatcacgccctttaaagatttcttccctgtcagccagatactgacggtaggatgcctcgatcggctcattgtaatcaccatccgtaaattccacattcttaagctctgtctggaatgtggtatggcggcagtgatcagaccagtatgtatcgagaacccggatttccgtaacggacgggtccctcttctcttcatttttaaaataattctggatatgaaggaaatctttaaaggtcatagccaggttcagggagctgtatagctcacccaggctgtcctctgcaaaatcacagaagccctcaaagattttaacgtcttcaggctggtcaaatacagtaacgagcgtggccggtttcggattattattctccctggaatccaccgggttaatgcagagggatttgacggcctctgcctgctctttcgtcaaggttcccgaaatgacataggtagtagccgatttgataaccggattctcttcctcattcaaaagctttacacattgttcagcagagtctgctctctgatcaaactgcccaggcaggtattcaacggtaaatatggtatctccctcttcagacggaaagctttcttcatatacaaagtccaccggcggctcagaaaaaattgtaaccagcgcctctttataaacctcttcagatacatcctccacatcataacggattaatacgcggacatctgtgattgtgccgatccccaggtaattttcgatctcctggcgcagttctttcgcccttacggcatattccggtttcttctcaacgaaaattcgtcttacactcattaaagtacctcctagtttttctgctggcaatttctattgacactgcatatattgaaaaagacagacgccttctgtcagtcatctgccttaatcatacacaagttttatagattagtaaaattaatatatctaatattttttattaacaatacttatttgttttcccgcttcggatggccggtaaatggctggtccggttcagctccagaagtgtgccaagcccggtgtctttttcataatctatgaccgtgatactggcattcctgacaataatctcacgcttttctttctggtttctgagaaggtagtcgatgagatagacaaggatgccgccgtgggctacgattaccgcattgccgccctccgtatccctgagtacccgttcaaccgcagaccggctgcgcgcgcggcaggacagcctgctttctcctcccgtcggcgctgccgcggcaggattcatctcccaccgcctgtaatcatccggatacttttcttcaatctccttccaggtacagccctcccacagtccgaaatccacttccttaagctccggcagcacagttacaggcagtcccattttccctgccacaatctccgccgtctgtttggccctgagaaggggacttgaaaagagtgcccgagcctcacaatgctccatggcctttgccagaaatccggcctgttccataccgtcctcattgagcaaaacatccgtctttccctgtatttttccttctatgttccattttgtctgtccatgacgcagtaagtaaaatttcatatcccggctgtccctactctccgctgacgctcatcgcatccagggtcagcttcatgatatcttttatctcctgctccgtcatcttcatccgttcggccagttcttccaccgttgcctcgcgtccgagttcttccgccatccctgccgatatatcctttaagacattgacacgggccagcatctcctcctctaccttatattccgtattctgaagctcaagagcgtcttctatcatcctttggatgcgttcctccgactggctgtcaaaatctccccccttgtattcctgcgccgtaagaagcagggcgatattcgcctcctgcaccagatcgttcatcgacaggccgcgatccctgtattcttccgccattctgaccgcacggcccagttttccttccaccagccgtttcacggccgactggcttcccgccagtatctcgtccagcagtctttcttcctcttcgggtgaacatgggggaaccagtttcagttcttccagataaagctgatagaaatcttctcctgatgtaaattctctttcgtcaccggaatcaccggctgctaaaaaatccttcaagctgtcgtttgccatgttatctgtttccttcctcatattctgtgtcaggcatgcagccgcctgattattttaaatacaatagccctctccatcaccatcggctgtgagtgggcaaaaaacacaatgccgtccgtcggagccagaagccggcttatcacctctccgctccccggctcaatgattgtcgccatcaaatcacctctgaggacctcggcccccggccaggtctcccgtctgaagaatccggcccggtccgtctttacattcgtcaaatcctcttcgcggataacactggcaatatatccgctgtgactgctgtaacggataatccccattcttgtcagaaagcgcagcacgctggatgcggcctgcctggccgacggctcattcaccgcttccgtggaggcagaatacacggtaaatgcgttcgttccattcatctgccagttataattcaaagtcgccgtatcatagggcgtgggtttgcgcattaccacatacggcagcccaaagagatttgcgaggcccggattgtgatatcccgtctccatcattctcacatgtgggacatagtcccctgtcatatagagactgccaaactgtatcccatatccgtaatccttcactttatcaaaaactccggcagccagtctttttgtcgtctcgccggttgcatccccaggaaaaagccggttaatatcggaattatcggtagaccagaaatgtttcccgacgttcatggccggataattgacggatgggatcaccagaatctcattatcccccacgataccgccgtgcagctcaatatccttgagcagcttgaccagcagagaacagatgtagagctgctgtacttcatggccgcgcagcgaacccacgatacaggctgccttcactccgtttttaccaaaacggtatccgtatatattaaaatcatccctgtggatgttcttcatagaataaatcagttcctgtctcatcggccgccacctcccagaatcctggcaatcagagaacctctctccaccatcggataggccctcagtgtaaagattaatccatcgcagggagcatacagccgctcttccacagttccctccagcggattgacaatctcgccgattatctcacccttttttatatcattcctgtgtttaacctttggtacgaagaggcctgatttttccgcattgacaaaaccgacttccccgcccagggagaccaccggctccttcggcgtaatcaccggcccgtcccagattcccaaatccttcatcaggcaaaagataccgtctacgagctgaaaacagaacttctccgtgattctcatgccgacccccatctccacaacgagagttgggacgccaatcatgttcagtgtatgggcaagcgttgattcgagtactgtggacgcgtgatgcacccagacaaattccgtgttcagtcgtccggcatatttaagaaggctgccggaagtgctttcattaagacgcacctgcgggatttccctgatatagatattgcttgcatggacatctatacacatatcggcgccagccaggtctttgacaatcatcccggcaaccagctccgccacagagccgtcgtccgtccccgggaaaatccggttcatatccacgtcaaacacaggaaatgcccttgtaatcgtatccagccccagcggattcagcgccggataaatctcaaccgttccctttaaataatggatctgttcccggattcttctgttcagttcataacagacgtactgtccctcaagctcatcaccgtgggttcccgtcaccacacaaaaccttttttcactgcctgtcacctgttccggagtgataacgttcttccggattaaaagtttttcatttacaggcagctctaaagaagctactgtctttatcatctgtgttttcctctgtatctaaatgctggatctgaaaattcctcttcggaatattctatcaaaaaacggcaggatagtaaagatgaagatttagttaagcaggtgaggacgccgccgcaggccagcggacggggtggtgaagtgtgtatatgagtctttcgtcccgggggatgattgtcgtggtttgggactgcgggcgaagataaagtctgcggagcacactcccgctctgtgaaatgcatcgcgctgctaagctcggcaggacctcgctaatcagcgatggatttcaacggcatccgcagactttatcttcccctccgcccccaaggtcaggttttcgccgggacgaaagactccgccaagtgtatcggccccgtccactggcctgcggccgctgaatgtctcacgcgttaagtgcggggcggaccttgtcgcggccactaagagcttccgtgggcgggaaatacgatatgccttcgattggtctattataaaaaattatggaggatttgatatcagcctgccggaaacacgtagtggccgcgacagggccctccccatttaagggtagagaccatcagcgcctaacggaccatgtccggcgtcgcgaaaaccttcgcctgagtcttccgtccccggcgaaaacctgaaccggggaagtaggcggaatcaattgcggaggggacatgggagtccgccggtgcttagcgaggtccctcacgagcttagcactgctgcgcactccaaagagtgcaaacggtccccgcagcaattcattccggccggattcccccttcacaactaacctcccacggggacggaagactcagccagcccccccaccacaccggacatggtccattccggacgcgtcctccgggcctcagttaaatccctatttacttcctccggctcatatgctaaacttggaacagaattataagggggactaataaatggacataaattatgaactatacaaagttttctaccacgtagcctcaaccctcagcttttcggaggcatcaaagcagctttttatctcacagtcggcagtcagccagtctattaaggttctggaaaaaaagctgaatcagacgctttttatccgaagtacaaagcgcgtccagctgacaccggaaggcgagattctgctaaagcacatagaaccggccatgaacctgattaaaaagggggagaaccagcttctcgaggccaataccttaaacggaggccagcttcggattggcgcaagcgatacgatatgccgatattttctcgttccctttttaaacgaatttcacaagatgtatccgaatattcatattaaagtcacgaaccgcacttccattgagtgcgccagactgcttgataacggacaggtcgattttatcatcaccaattatcccaactcagggctgtccaatacgcagaatatacaggtcatccatgatttttccgatgtatttgtggcaaatgaaacgtattttcccctgaaagacagaatgatcacactgaaggaattgcagtcctatcccatcctgatgcttgatcgcaaaagcactaccagcgaatttctgcacagcatgtttcagaagcaccagctggatctggtacctgagattgaactgagcagcaatgatctgctcatcgatttggcgaaaatcgggctggggatcgcgtttgttccggatttctgcattccgcagcaggaggaaaatttcttcattctcaatttggaagaaacgcttcccaagcgccagctggtcgtcgtccacaacgaaaccctcccaatctcccaggccgccaggcagttcattgagcttcttgagggaaacacggacagggattagaggcggttccagaagttttccagttcctgccgcaccgtcttcagggtcacgcggcggcagtcgtcccactctctcggaaacagctcgcggtaatcatttcgtaagaaccggtcgtccagcagcaggatgatgcccttgtcaccggcggtgcggatcacgcgtcccgccgcctgcatgactttattcattccgggatattggtaggcaaaggcaaatccttcctgctcctcctcgtcaaaatatcctttcagtatctcctgctccgtacagaccatggggaggcccgttccgacaataatagctcctatcagcctttcttctttcaaatcaatcccttcggaaaacagtccgcccattacgcagcatgcgacaagggaattctcccgttcctgttcaaactcttttaaaaaatcttccctctgcgcgtccgtcatcctgttttcctgcaccagccagtcaatcccggaatcctgcaaatatagcttctgcgcatccgaaccatccgcaaaatccggctgccctatccggccgtcgtataacagctccaaaacatggttcatgtattgataggatggaaaaaaaacaatataatttccttttctggcctccgcggcctgacggatataatccagtatcttccggtattccgtacggtttctcctggtataacggcttgtgacatcggcagcagccaataggagtcggtgctcctgtgaaaacggtgaattgacatataccgtgtaatcttcttcatcattgctcaaaagctgcctgtaataccgtatcggcagcagtgtcgcagaaaaaaagaccgaactgttcccttgggcaaggcattccccaatatgcacaatcggattcacgcagagcagctttatcttaaaatcgccggactctgtcaattcagtgtaaatgcggtaatgttcgtcgactctttcataaatgttcaggaaattgcggacggtaaaatagaaatccagcagctcttcccgtccctcacttcccttatattcatccatgtatttttccagctctgaaaacagggaggtcagagccgtcaccagatgatccacatcgggcaggatctgccatccctcacactggcgtttcatttccagacaaatcttgttgacgcgttccagctgccttgtcaggcgcggtgatttatcttttacaagacgttttgctgccagcacatcctcttttatcagaaccgcgctgtacatctccctcgccctcggcaccagattatgggcctcatctatcagaaaaatatactcccccttcgccccatccgcaaaatagcgtttcaaccggacatccggatcaaacacataattatagtcacagattattccatccacaaagctgctgatatccaggcagtattcaaagggacagaccttaaatttctccgcatatttaagaatgacttccctcgtaatcccaaactccttatggacaatctcatacaccgcatcatttaccctgtcaaagtggcctttggcatacggacaggcatcgggattgcactccggtttttccaaaaagcagagtttatctttagctgtgatggttactgagcggaaataaagcccctgctgccgcagaatcgcaaatgcctcctccgccacgcctctcgtaattgtcttagccgtcagataaaaaagtttatctccatgcccctctccgattgccttcaggctgggaaatacggtggatagtgtctttccgattccggtcggcgcctggataaacagctttcgccgcctcgcttcagtccggtatacactgaccgccagctccctctgcccttcccggtaagggaacggaaactccaaatctttcagagactcatcccgtctctgggcattgtggtaaagatatctggcccacttcacatattcatggatcagtcccatgaaccattccttcaattcctccatggttttgatgacctgaaaacgtcttacctcctccgtatccagattacagtatgtcacctggattgtgagttcttcaagcccctcgtttaatccgtagaaataaccatagcacatggcctgggccagatgcacctccaccgcctcttccagaacgctgatatccatgtaaacgccctttatctcatcgattgtcgcccggtttccttccctgataattccgtcggcccggccttccaccagaatttcgaagccgtcctcctccacactgcttttcagcggcacctccgccaggtagccggaacccatctttttctggattttgcggtgcatacggcctcccgccagcattgcctccttctgatccacagccgtccttctattatctaaatcgccggagcgcaggacaaattccaccaggttgcgcacagaaacccgtatctgttttcctttcatctccatctgtccttctccttccgactcttatgattcccttttatattttataatatagcgaaaagggatcgcagtctcctgcaatcccttttctcaattgtatgcaaattttttaagcagctgtgacagcctttgccgctgtcctatctagaaatgcttcaaattctttattttccccgctatattctactgtcaatactctggtcaaatcgaggctcataacgcctaatagagatttggcgtcaatcacgacgcggttgtaaaaaacatctatatcgaattcgcatttcgttgcagctgctacaaaatcttttgcatcttctacagtacctaacattattcttttctgcttcataatcaaaactcctttaactggtgcaacttattgctgattcaagtattacttatagcaccttatgcaaaatttgtcaaattttctttctaaaatctgggaatcggctcttgtaaattattgacaattttacattctctattcagaaatttatgatcgtttttaccagcacatctactttcgcagctttcgtttattagaactgttgtaaagattatttttgataaggtgtgcagttcgcctaaatttataagattacataaaatttccagctaaacatacgttctcattatagtatataaccttgttccgtgcaatcttttcttcgatatttccttttctttcctgtgaggacgccgccgggacggccagcggggggggatatgaggcttccgtcccaatgaccgtttatctccttatctctgatgatgaacaagcactccgccgcctacatactatataaagaggaagtaaatagtatgatcctccctgataaaataaaagaggtgatcttatggcatatgaccagataaatcccaacggcagagacaagattccacgctccgcaagaagcacggaacctgcatgggtaacgaccgtggctcttcctcccgaagcggcgccgtttgacctgcaggccgcaattaacgcagccggcgacggagaaccgacggtcatcgaactgaacagtgatatcatactcaatggatacgatattaaaataccacaggataaaattataaagcttacaagcgccggagcagaaatcacccattcaattgatgccaaccggctttttcgggtactcagcgtttcgtcccaagcggcgctctatttggaaaacatcatcatcaccggaggcgttggaaccgacagcggggccggtgtatcggtttttggcggcacgcttgtcatgaacaacaatgccgccataaccggcaatcaggcttccggagccggcgccggagtactcatccggaacggcggtacattctgcatgaacggcggtgaaatcaccaataacacggcagggactgaaggcggcggtgtcaataatggaacgggcggtatctttctgatggccggcggcatcatatccggaaattcatgtccgcttatcggcgcatccagaggcggcggtgtgtttaattccggtatttttactatggaaggcggtgaaattttcggtaactatgccatcatttccggcggcggtgtattcaatgccgcgtatttcaccatggaagggggtaagctctgcggcaactcttccggagggaacggcggtggcatttataatgccggcagtgaaagaagcttatttatagcgggcggagaaatttccggcaattttgcagcgggcagcgggggcggcatttatattcatcccgtggagggcaccgctcccctgataaccgtcgcaggcaaaagcctgatagcggacaacatggccggtcatgacggcggcggcatctggatctccttcgggcagccctgcaggctggagattgggccggacacggtcttttccggaaacaaggcttcccgggcgtttaaccgcagcccagccgacgacggtgcctgcagtgatcatattgctgccgtccactggacatctccgtttccgcagggatacaataactatgatatcagttataccaacggcactcccttcctcttcccggcaaaggttaccatacaggccgatcaaaaatcggtaagccaggctctccccgccggacggtttgcattcggactgtttaacgggaacggaagccggattgcctctgctgtcagcgatgctgccggaatgattatatttccctccatcacaatcacacagaccggaattttcaattattcgatacgtgagctgacgcaaaacggcacctggagcaatgataccggatatcccgtaacaattacggtcactgagaatggaaaaggacagttgacggcaaatgtctgctatcctgacagagcggttcttaccggtacattcaggcattccgttccaaagcctgtaactgtcaggttccatgcaagaaagaatgtatgcggagcctgccagtacgccggccggttcacctttggccttttcgatatcaaagggaagcgtgtttccgctgcagtcaatgacgcatgcgggaatattgcctttccatccatcacgtataccaaagcaggtatttattactacaccatccgcgagctgacacagaaaaacggccggacggcggacagcaccgttcacccggtaaccgttaaggtatgctccggccagggccggctgactgccgatgttcagtacccgggcggcctgccctgcttctgcagcacatgcaaaccgtctgtaccggcccctgtgaacgtaagcattcatgcatgtaaaaacgtctgcggtgcgccgctttgtgcggatcagttcaccttcggccttttcaggcaaaactgcactaaagccgcgcaagagtatccatgcggtgaacctgtattcataagctgttgccgcatgccctgccgttttaacggctggtaacgtacggcaggaatctgaacccgttatattcctttgaacattaaaacagggagcccaagcggtaaaactgatcggctccctgtctttcttctccacgatattctctaattttctttatttttactctgcttgctccggttctctatttcactcttacaatatgctggcagtaaatataaagattttttatttttactgcctcctgaccgtcatctccaagcacgatcggctgggttcctgacggagtaaaatagagtttaaatgcaattgcatcctggccgatattaagcctctcctccggctcatacggaaactcccggcatgaaagtcccagatatgaatacattacccgctccagctcagggtttctgaaaacctgaaccacatcctcctcggcctcgcctttcatctcaatgattgctttggcctcatcaaatttcaaatttgtgaagcggtattcgccgtttcccagaatataggctaaagtaccattatcaagcaataataaaggatctgatttccccataatttcttcctcctccaccatatgtactgcaaactgtatttatttataatataaagaatgcatgataaagtcaactcactgtcaagaacgtaacaatatctccatcgtctgttccagcctctggcggctcaggaacaccccgaccacgcctgagaccatactcaaaacgttaatctcttccaacgtccagacacgtttttccccgcactggtcaaagccgatcaatcctcttctttttttcttttccactaacaggcactggagcatggatacgatatcctgtgacgccagaacgtcttttgttcttccgctcagatttccgatatcacggcaataaaatattccgttttcatcaaacagctgatcataccggttcccgtccgtgtattcaacatcctgaagaaaatccttctgaggctttacgccgtcattacaccattcaaatgtgttggagcagagcctgccatcctctgaatcctcaaaaatataaacccggctcacgccaaactggcggccgattatctccagcacctgggtgatggcattcggtatgtcttcctccttttgcagtaccccgaacacatactccgacagagtctggttcctgtatctttcctgcattcttatttcaggagccttctgtacatagcttcgtccggcattgaattctgattccagaatggaatgataaaaagcgcactggtttttccccttttctttcgccttgtaaagagccagatccgcatttttgtataattttttataatcattaccatccagaggggcaaacgccactccggcgctgcaagacagcatataaccgtcccgttccaggaactcctccattttctcttttatctgttcaaatttatcggctatcacgtcctgggagcgggcccccggcattatgataacaaattcatcgccgccaatccggcctacaatgtccccggcacggaaggtccgcttaagcagtacggcaatatccgaaagcagcacatctccgctcagatgaccgtaaacatcattaatgtatttgaaattatccaaatcaataatcatgaatgcacagggcgaatcctgcattgctttttcaatgaacttgcctcccagctcctctgccgccgccttgttgtacagaccggtcagagcatcatagagcgccttttgaaccagcatatcgacatttcgtttctccttatcgatatccgatattactccgatcgccctcttcctgccggactttcttgtatcctgcaaagctattctgactctgcaccaaaaataatgcccgtcattcccggcgattcttatctccatctcttttaccggaacatccatcttcatatcccgggccgcattcatcagcagatgtatatcatcagggtgtacatggctgaagggggccatggtgctgacattctccgtcatgggagaataaccgaaggttttcacccagttgtccgaaaagaatatccggtcatcagacagatcccactcaaaaataatatcattggtctgctccattataatccggtgcttttccagactcaggtgcaattcctcaagaatcttccggttctctgtgatatctgtcaaaatacagtagaatactttctttccatcccgctccaccagctgtccgtgatccagcaccgttaccagccttccgtcccggcatctgactctgtactctatcttctttgtctttccctgtgccatctgaatctgtacagaattccaggtgctttccagatcttccgggtaaatcaggcgccggaactgattatggaatacctgttccatctcttccctgctatatccgaacatatttaaaaagccctggctgtactggagaagattcagttcttcattatattcacagcatatgactccgcccggtacattctccatcaatgcatttaaattctcattcttctctttcagcagcttttcctgctcttccagccggcgaaaaagcgccctggcatgctgctgatccattgtcctggggaaaatttcatcctcgagctgattccggcttccttccgacatatgaacctgcagaaccttcagctcaccgttttgttccctcaccaccgcagtgacccgaatcttcagcttatcaaaaaacgcctctttaccggactcctgaatcaccagtttttctgataccgcagcagtacggggatccaatattttaatatcatactcttcttccaatatatcaaaaggacttggatacaattgatattcctgttcaaaaaatctttttgcaccggaaatgccacggccgctttcttgctgtcccgttcctatccattccacattttcatccatgccggataatactttctgtacatcgcgctctaccagatatgctctttgaagccggcagacaaattcttttactctgttttcaaacaatatgtccatgcccccttttcccccataacatttcttaaattaagcatactggaaaacatggatcatgtcaagaaagcatcattgcacctctgctgcattttgaacgaaaatcccgagtttcacggtgcgtaacggcacttttgaaaaaaacaatcaaagccgccatttctaaattaatcggctatttactgtgaaactttaacttctgggaagccaaaaaagcgcagacttcccccatcaacctttttgacgtttattttgaactcagctaacaggttcaggcggcaactaccggaacctcccacccaagcgcttttaacttctttaggtacgcattaattttacgttccttgttgaattggttgtaataatcagcacccagatctttgaaaacaactccatccttgagtatgtgatagatggctataagcatggaatgggcaactgcaacataagcccgtttttttccacggtgggaactgattctcatgaactgcgcataaaagtacgaatttttatttcttgtagcggaatgcgcacagactaccagggttgaacgtaaaagagcattcccttttcgcatttttccggtcttcctcttttgggcactctcgttattgccgggacatagtcctgcccatgcagcaagatgaccggccgttggaaaacgactcatgtctgtaccaatcaccgaaataatggcctgggaactgttttttccgataccagttacatcctggattgcttgtgtcgctttttttttcttccggtttcataaagttatcaatctcatcttccagattgttgatatgaacattgagttcatccagatgggacagcagctctttcatcattcgacgttgtaatggggtcatgacaccatttaaatcatcgataagctgttccttgctggctttgagattgtgggcaatgattttctgtttatacatttcatcatactttgcttcgtcgaagaattctccggtgagaaggtattccagaatgttgcgcgcactcatgcagttgatgtcagatacagtaccggacagctttatgttggcaccctccagcatcttttggagtcggttcaattcccgggtgcgttcactcacgaggcttttccggtagcggaccagttcccttaactccctctgctgtttatccgggatataactggcttttaataatccgtgctgaagaagctccgcaatccattccgcatcctttgtatcggttttccgccccgggactgctttcatatggctggcattcaccaccatagcctttagttcagaagactcgaggatgttatacagaggcttccaataggacgctgtgctttccattgcgaccatttcacagccaccgttctgaagccagttagctaattcaagaagctctctggttgttgcaccaaagttccgtaactcctgcttgctgccttttctaaagcaggcgacgatgagctttttgtgcacgtcaataccacaacatttgtcgtaaactttatccatatggttacctccaaaataaaatttacggcacggtactctgtctattattattttactgtacgtccttctgccgcaagcggctggacagatggtggtgcaaatgagagtacctaaaatcagtttagcgaacgggctacaggcccaaattagtgccgatttttgccgttaatgtcagtataagctcaatcaacagcaatttcaatcacctgccgccctcgcagtttcatttatggtggtgccgcatcagaggcatgggggtttagtatctgagtctaattctcctcttttcaaaaaggaaatcgaagtggtaattaaaatctgcttcaccgctctcgaagcaggcaggaacatttgttctgcataagtgcaaaaaaaataatttataaaacttattatatctaataggctttataaattatttttatcacacttagaaacttctcttttgctctccttgaaaaccttgatttcacaagattattcagcaggggaagagggattcgaacccccattaacggttttggagaccgttgctctgccattgaactattcccctaaaattgccttcccaagtataataccacaggacaggcagtatgtcaatcggttttttccaaattacaaataaattgttttaattaatgaaattattgtaattgtttcgctcaacgtaacaatattgcttcttaaccgcctgtcctggggttaaatcaggttgattgcctctcttacattgcttacccccgccagctcaatatcatttctttttttcagcttttcaaagcttacgagcggcatgatgcagcgtgtgaagcccagcttcaccgcttcgttcactctctgttcggccattgatacggcccttacttccccggatagaccgacttcgccgaatatgacggtcttttcatcgaccggtctgtctttatagctggaaatcagtgccatcacgatggccagatccagcgccggttcattcattttcataccgcccgcaatgttgacataggcatcgaattgggacaattcataccggcaccttttttcgagtaccgccatcaggagattcacccggttataatcagttcccgctgctgttcttctgggcattccgaaattcgtctttgtcaccagcgcctgtacctccagcataatcggcctggttccttccaatgaacaggcggcaacggcacccgaggctcctgcgggcctgccgtccagcatgaattccgatggattctttacttctgccagcccctcctccctcatctcgaacacaccgatttcattcgtggagccaaaacggttcttaatccctcttaatatccggtaggaagcatggcggtcaccttcaaaatagagcaccgtgtccaccatatgttccagtaccctgggtccggccacaaccccctcctttgtcacatggccaataataaataccataacgcccagacccttggcaatctgcatcaaaatattggtgcattccctcacctggctgacactgccgggagccgaagtaacttcctccatatacatggtctgtatggaatcaatcacaaccgcatccggcattgtccgtttaatcacctcttctatggtccccaggtttgtttcacacaggaaagaaagggggcctgtcaccgtcccgattctgttcgcccgcagctttatctgtttcagggattcctctcccgatatgtaaagtattttctggttctgtcccgccagattacggcaaacctgcagaagaagcgtggactttccgatgcccggatctcctccaaccaatacaagggagccccttacgatccccgagcctaaaacgcgatccagctcatcaaagccggtccgtatccgatcctcctcgtccagcacaatctccgacagcatgacaggcctggccgtatcggcggataccttccgggcagagccagtcccgcctttaccaacggtttttatctgggagaccggctcctccaccatcgtattccacgacttgcatgccgggcactgtccggtccatttcgccgactcatagccgcaatcactgcaaaaataagctgttgatttcccttttgccattctctcctccgtaaataaatagtcgccgacatcagaatggaggcaaatctttcgaccgcctccatcctgtaattctgcttatctctatcttcctgcaattcttatctctgttcttacgccctcgttcagttccacgcttaaaacaagttttccgcttacgttggtcgtcatgcctcctacggcaatcccatcaatgaaaacttcatattcacgatcatcttcaagctgaactgtgatctgagcatcctggtttccttctacagcaaaggttacctcggaatcatcaacagcaaaatggttaactgccgttcccggtacggactcataaacaaacattccgttcctctccagttttgttatctcatgaaaggtttttactttgtataaatctcctttgtattcaaaatcctgaagtttggactttgtcgctaattcataattgccaaaactgattgtaccgtcatcctcgatgcggattaactcgctaactactggcataaatctatcctcctggtattcttctgtgtgtttccctgtgtaggattattctatcacagtttcttttacttgaccagtattttattctctttggaagagtccctgacggtaaatttaaggccctccccgtctctggttacaagcacttcatcgtcctttttaatatgcccctccagcagttcttctgagagcttatcctctatctggttctggattgtccgccgcagcggccttgcgccgtatttctcatcgtatcccttctcagccaggtatgcaaccgccccgtcatcgacagtcaggctcatgccgacctgggctttggttcttctgataattgttttaagcataattccggcaatctcttcgatattcttcttattgagcggatggaataccatgatttcatcaattcggtttaaaaattccggtttaaacatccttttcacttcatccatgacacggtttttcataaactcgtaatccgtcttcgcatctgaatcggaagagaatcccagacgcttcggtgaaatgatattctcggctccggcattggatgtcatgatgagcacagtatttttaaaatcgatctttcttccctgggcatccgtgatatgaccgtcatccagtatctgaagcaggatattgaatacatcgggatgggctttctcgatctcatcaaacagaatgacggaatacgggttgcggcgcaccttctcgctgagctggccgccctcctcatatcccacataaccaggaggtgagccaatcatcttggagacactgtgcttctccatatactccgacatatctacccggatcatcgcattctccgtaccgaacattgcctcggacagcgcctttgacagctcggttttgccgactccggtgggccccaggaacaggaaagaaccaatcgggcgcttaggatcctttaagcccacgcggcccctgcggatcgccttagaaacagcggttaccgcttcttcctggcccaccactctttcatgcaggatcgattccagttttaagagtctctccgactcctcctgtgccagctttcggaccggaattctggtccagtcggatacaatatccgcaatctcattgtcaccgaccaccagcttccgtgaatttttttccttctgccacttatcgcggattttttctatcttttctcgttttttatcctgtttcttttttatgtctcccgccttttcataagcttccgccttgatggcgtcttccttctggcgttcgagcttcttaatatcctcttcgaggactttaatctcttccggctccgtgtaaacggtcagacgcagcttggaggatgcctcgtcaatcaggtcaatcgccttatccggcagaaaacggtcgttgatataccgggccgccagcttgactgccgcctctagcgcctcatttgtgatcgtcaccttgtgatgctcctcataccggcttctcagtcccctgagaatctcgattgaatcctcctccgaaggttcctctaccataaccggctggaaacggcgctcaagagccgcgtctttctctatatatttgcggtattcttccactgtagtggctccaatcagctgtatttcccctctggccagcgacggtttcaggatattcgaagcgtcaatggccccttccgcccctccggctccgatgatggtatgaatctcatcaatgaagagcaggatatcaccatcctcctttacctcggacaagactttcttgatacgttcctcaaattcacctctgtacttggaacctgccaccatacccgacaaatcgaggctgacaactctcttctttgcgattgtctcaggaacattgcccgatattatgagctgcgccagcccctccacaaccgccgtctttccgactcccggttcgccgatcagacagggattattctttcctcttctgctgagaatctggattactcttttcatctctgtctcgcgtccaatcaccggatccagttttccttctttggcaagctccgtcaaatcccggctgaagctgtcgagattaggagtattacctttttcttttctgagtctgccggccgcttcctcccggcccgcggggacatcatcccccatggcagccatcagatccacgtataatttttgaatatttacattcattgtattgagaaggcgtgatgccgtgcatttcccttctttaatcatggcaatgagtatatgctccgtccctataagaggagctttaaagaaaacggcttcctcataacttgcctgcagcactgccctggctcccggtgtatactccgcctgatctgctgttctcgttggcacggccggtgaaatcaggcgttccatcagctccagaatcttatcttccgtcacatcataccgctccagaatggcagcagccacaccgcttccttcctttatcagtccaagaagcagatgctctgttcccacatagccgtgctccagctcctctgctgtctccacagccaggcggattgcctctctggctttctgcgtaaaacggtctatcataaaatgttcctcctgcatattcattactgctgttctctatcagttactgttcaaacgggggtattcctcgtgttattgatcgcaccatactgcttttgggcgtagtgcgaacagcaaccttcatcatttaagctccggcaggtgttccctgagatatctgcccctagccacttcaagctcatctttgccgagaggctgtctggaatacttctgaagatttgccggctgaattcctatcatcaggttataaatgcctgcgaactccttcgtctcaaccagaccgtccgctatcccggccctgagatgggacaggaaggtcatagcctccttcatggaaagctttcttgcgtatttcaggactccgtacgatttatatacttcatcttcacgcaaaagacggtgctttgacagggaagcctcccttatctcccgttcctgccgggaaagctgtacggctacactgctgacaagctcgatgatttcctgttcattcatccccagcgttttctgattgtaaatttcatagagatctccataattctccgttccgcggccgtagactcccctgaccgtcgtcccgaatcggctcatatctcccagaagatcctgaaaccgcttgctggtagaaagagaaggcagatgtactactaccgatgccttcattccggtccccacattggtgggataggccgtcagatacccatatttgctgctgaacgcatatggaaattttgcattaagataatcatccagtttatcagcttcatcatagcaggacttaagctccagtcccggagccaggatctgcagacggatatgatcgtcgccgttcagtacgagacttaccgcttcgtcatccgaacagataatacttccgggagttttcttctccaccagcgtcttattcagcaggcggcgctccctcagggcgacgcggtccagttcttccatcttatccaaagccctgaactcataccggcggccgtcctttccctggatatctctcaattcctgcatcatccgccctaccatgtacctggcctcattgtcctcaagcctggaggggaatttatactcttcccagtttcttgaaagacgcacccggctggatacaatatttgacggatcattctttacatcttcaaaccatctcgtcattcttttcattctcctcttttaaggcctttattctgtcacggcagactgccgcttcctcatattcctcagctttaatcgcagacttaagccttctctccagctgcttaagctgctcctctgtggaaaattccatgacaccgccgctggtaacggctgccgtccctcctgccggccgaatcttcggctgtttacccgtatggcttgcgctctcctgtaatttcttaatcttctctcctatcagcagatcaaagacatgatagcagtcggcgcagccaaaacggctgttctcgacaaactcctcgtaagtggtcttgcaggtgggacaggccacctcatccatcttctgctgccgcgcggcagacggctgcagccccagcaggcttgacagcagcttgccgagtggaaattctccttcaattatagcggaataggggccgaaatccatctcctgcgcacactgtgaacacagattatgctctgtcttcactccattcattacctctgtatatttgatatttgcttcacgaattctgcatttctcacataacatcttcttatcctccatgaaaaaatgccagcctttacccggaaaaagcgtcaaaaatagaatctaccagccgatgaacctcttcacggctcacattcttgcaggctcccctggcaagaataacgcttaaatcacgctccatctcacggattgccctgattttatcggcatccagagatatgactgcgcctctccgtcgatccagcttgacaaaaccttcctgctttaatacagaatatgctttattcaccgtatgcatgttaatcccgatgtcatcggccagttgacgcacggaaggcagcgtctccccttcgcggagacgttctgttgctatgcctattataatctgatttctaagctgaatgtaaatcgcttcatcactgttaaagtcgatctctacaatcataatccaccatctttcgtcaatttgttatagtgattatataacaaagcaaacatgaagtcaacctgtaaaatccttgtaaatgctcatgccgtttgaacagtttgttttgttaatcaggtgaggacgccgccgggacgaaagactcagccagccccctcaccacaccggccccggtccgtttcggacgcatcctccgtcctcaaacaaactattactaaacagaggcaaaccggacataaacggttcggctttttccgccccaccgcatgtccggttctcctcttttgtcttaattcaaatcaagaaactcaaaatcatcattgtccggcctggaggaccttcttcctgtatctcccgcttttgcggcacgggcccgtctctcgtcttcaaggcgctcccgttccaggcgttctcttgtttttctggccctctccgcccgttccagctctctcagcctgatagcctcttccatacctgcatcctggcttctcacaggtttctccggatagcgctgaaccgtacggccctggtcggcacttctcctctcaggatagccctgtccggctcggcccggctcggcgctccttctctcaggatagccctgcacggctcggcccggttctgcattccttctctcaggatagccctgcacggcccggcccggctcggcgctccttctctcaggataaccctgcgcggctcggcccggctcggcattccttctctcgggataaccctgcgcggttcggcccggctcggcgcttcttctctcaggatagccctgggacatgcggctctggtctgatgtccttctgtcctgatacctctgctcctggtgtgccgtctgtgtatatcttcccgccggggttctctcgtcctggtatctatcctggtgcctttgttccggacggccctgctcaccatatctttgttccggcctccgctggaccggacggccctgttccgttcctctctgttccgggcgtctctgcggcagatatccctgctccgccgttccggccatcctgcggactgcggcatcctgataaccggacgcctggccgtatctgtcgtttctcaccgtttcgctgctcattctgcgttcctgtgaccggggataatcgtctccggcaggccgctttcttggtcctgaaccttcattggacgctttccctgtccgggactgtgcagactgccgccttttgctttcttcctcctgcatggcccggcgtttcacaggtgtcagagcctcttcccgctccggtctgcccgaatactctcttctgcgcatcaggagattaatgaccataaagaatagaatcaggcagactacaatcagtactacaattacaataaaccgcagatcgtaatccttgcaaagcgcattataatcctcatacagcttcgctaccttctcttcatcgtaaggactttcaagtgccggatcctcaaaataccgctggaatgtcttttcagctatatcgtaacggtaaagacctttttcaccgttctcattcataccatatacaacgcagtatttttgctcttcatccgtcttccacacccatcctttgactttagaatcgccattcaactggattgcagtctgggcaaaaccggcaggaacttcgattgagtcatcaatcggcagaaccagaatcgatctcgccacgctgtctattgtaacatagggcgataatgctcctgtctccggcatgtaaatatagaaggaaccttttccatcacttccctgtaaataaatcaggttaaggccatttccggctcccgacataatctcagttccgttatatgtgactgtagactgtgtatatccctccggcaggcccgcaggatcaaaggatgtggcaacactgtattccactccgtcaatatccgctttcagctcaccgacaaccgccccgcccgtgacagccgcctcattagcatcaccggccggcacttctgaggattccgacttgttgactgttatcgtataagatttaaccgtctggccgtcttctgccgtaaccttgcataccacggtattcgccccggtcttaagacctgagccgccggtcaccagtgtcttggctttgccgtccttcggttctccgctgactgcaatcttgtcaacgtcagcgcccacattcaccgtgtaagataatacatccggcgaaaaagccggggacagctgtcccggtgatactttaagcgaggccagcgccgcctcgcttgaataagtcgcaggagcttttaccttgactgctgacgaacctacctttgaaacatttacggcctgggtatcagagtcatagatttcatggctggccacggagattgtcgtgttacccgcctgtaccgctttaaatttcaacgtataggaaaactcagtagttgtgctggaatccatcgttccgacaaggcgcaccgaaccggcccccccatttgcattgtttccgctgacaaactcgatatatgcctgatcataggacagcaccaaatcggaagccccgaggtttccgtcagttgccgtaacttttaccgtcacattaaattcctgtccaaccgtcgtgcttggatccgaaaacgatatcttagcactggccgcataagacactaagcccccaaacggcatagccagagaaagggcaaacgcagctatcaggctggttactatatttcttactcttctgttcataatctctcccgcttaattcagtttctgaattcccaggatatccttctgcatcgcaagaatatccatgatgtccactttgccgttgccattgacatcggcggctttttcatatactcccgtgaggttttccagccccaggacatgtctctgggctttcagcacatccagaatattcacttttccgtcaccggtgttatctccctttacaattacatcatactttgcaacgggagaaccatccggaccataggcctggacaatgttccccgtaccgacactgcccgccacttcaccgcctgatgaagtgtagactttcacaatactgcccgcgcccgatgatgtcagggatgccgcaagctgtgctgctgtcacgcctgcatttacaacctgatttccattcccggcagcacccggatttacaccgctgctcccggagccacccggcgatacgccgggagttcccgtactccctccggggccaaccaggccggatgagtcggatgatgttccaaaaccggataaattaccgcccggagccataggaccggttgtacttcccgactcgattccgccggaaccggagccgtcaggcggcagtatctgcacattggagccaccactggagccgccgggatttcctgaattaccggatgggctggaagagcctcctccaggtccgcttccaggtcctcctcccggaccggcccccgatccgcctcctgatcccggatttactccgcttccgatcgaatccgaataggtagggccgttgtcctgacgcacaacatgtattacataatttctgacactgccgttctccgccttaacagctacggtaatgtcattgtttccgctctgcagattgatattgccggtcccgctgaccgacgattttgaatcaatcaccgaggccgcaaccgtgacgctgccgaccgaatgatccacaatcagatcataggattccgtatctctgttgaatgttggggtgagagcaaaaccttcgacacccaaacccgaaagcttattgttggggctgccgtccaccgtcggctttgcacaggccgtggcaggcatgttcttatatacaggaatagaaaactcaagagccgttgttttaagcgcactgatcttagccagtgtgagaccttccgcagcggcagccagtacattggtcatgtactgatgcttgtaaaggttgtcaccctgcacattaaatttcttcagatacaatgtatcctgccctcgttttacataattattcccataataaatggagcctccgagtatggacttttccacactgttccatggacgctcatagctgccggactgtgatgcccaccaaagtcctctttccaccgctcccattgaaccggactggtaagcttctatattaaaaaagttgtaatatccctggtaacccggcacagtacccgatatgctccggccggttccctggctgccctgctcctgaataatcatggatgcaaggatatatgggttaacgccggactgaaccgcggcattcataatgatatcgacataggaactgcttcccgatgccggcgcagcgcctccagagccgctgccggaactgcctgggtccgaaaagccggaggaaccgcccataccgggcccatatgccgtcatcacacgatttacctcatgatcactgatagatgcaattggcgatatcggcgtaattccctggccgccgtcacctgtaccggcagacgctcccggaccggaaccggcttcagctccgggaccggagcccggccctgcactgccggaaccggaggaaccgccaggggaggaaccgccggaaggagcacctccctgtcctccgcccgcattgcccgaaaggaatgttccggcaaccatgctttccagcccttctctcgtatgaatcgagctgtcataggactgcttcataaactggaaaatgtatttatcatttaaaaagtttctcgggtccatataatatcgaatgatatcctccgatgcctgtacccaggagcttccgtcaaatcctggccatgtccccgtgtcccagtcataagcgcctgttgccgtggatttccaggaggagatattttcccggccaaccaggtttcttccgattacactctcattttcaattaccgtattccagtcaaggtttgtttgaagcgccgtaaatgtccactgcggatattgcgcatgcagttcgcgcagccccggcttgtaactctccggaaatccctggctgttcatatatttttcaaaatcaccgtctgaagtgattgcagtaggaaattttatgtaatcactggatacaaagccgattgtctcggcaccgccgcttccgctgaaccggatctgataccataactttccgtctgttcccgtctgctctccgataacggtaaccggagccccttgcgacagcttggccacagcctgataagaagtccccgggccgcttcgcacattcaggtttgtcgcattgacagaagcagtccgctcactggccatactgaccatatcgaacaatccggcacgctccgtcaggcatgggcttaccgccagaatgcagcccagcagcagggcggcagctcttttatatcctttatttttcattcgtgtctctccccatataccaaagcaggtattttcctctatattttcaaaaatttaaagacattcttcaatgcaaaactatttattaagcaactgcctgatacggcattatgtacattataatgaaaaataccattatatgtcaacctcatgaacaaaagttcacagaatatccagtattttacattaattgtaagaatttcttaacaaattcccgccgggagcctaatcagggaaccaggacgccgatattcttccatggcttgtcacccattccggctttacccatatactgttattaataacattctaaaaggagtatttatccatgggtaattttaacgcagaatcagccgggcataataaccggccgatccaacacgtacacgaagtgatcggcagcacttttattgccgaacgctgcaatgatcctcacaatcaccgtattgccgctgtttcaggcaaggcaattccatttatggacagccatgttcacaatatcacgttccgtactgattcctatgacggacattatcatgaattttgcggtacttcctctcccgctatcccggttggagacggcagacatgtgcattttgcaaaagcatatacctcatatgcagacggacatgcacatgaattcagactggcttcattaatcaacgatccgattagcgaatgctgattttaaaataattctgtacaaaaagataaacggcgttaagtttgcatttctggcaagcttaacgccgtttgtttcttaactctttttgtcatgtacctgtgtttcctgtaccaattatgtaaatgtactttggtccacatatctttgacggccgggcagcatgtacgatttattcactcgcagaatatccgccgttttcaatcatataactgtgtctgcctgcatcgtcctcttcccagccggattttctcagcaaattctacccagcataattgtaacgagcatcagaaggattaacacggcctgctttaccgtatccttcctgcaccatttaagcactctgactgtcatatcctcctccgtctccggacctgcttttacatttttgcaaaacagtcccattatctatagtattatatgcagacaagagcaggatgttgactagaattattaattcccctcattacacaagaaagaatctcgcgagcgagattctttcttgaaatctatccgggattatgcaacggttcatgcggtctgaactgttacagcgttatacaggatatgccctgttcagcttgtcggccttatgcgggtcgattcctgttgtctgagcctcacggtattcaaagaattccttggcaacctgcgggaacagcgcataagtcagaacatcctcatcctgcttcttccactgggacatctctgcttccagcttctgaagctgcggctcgattaaatcggccggacggcaggtaatcggttttgcatttccaattgctttcttctgtacttcggcattgaacggttttacagtctggccgaattctcccatcaggagctttttggattctttggtaaacatcttgtagcgctgtcccatcagaacgtttaatacggcctgtgttcccacaatctgggaggacggagttacaagcggcggctcgccgaagtccttgcggaccctcggaatctcctgaagcacatcgtagtatttatcttccgcatgagcttcttttaactgtgatacaagattggaaagcattccgcccggaacctggtaacggagcgtattaatatccacgcccagaacctttgtattcatcaggccgcttgccagagcttcttcgcgaagcggtctgaaatattcagcgatttccgccagagcgtctttattaagccctgtgtcatagcgtgtgccgctgaatgtctcaaccatgacctctgttgccggctggctggttccgagagcaaacggtgacatagccgtatcaatcatatcgcagcctgcctctaccgcctttaaataggtcattgaagcaacaccggaggtgtaatgcgtatgaagatcgattggaagctttacggattctttcagagccgttaccagctcttctgccgcatacggtgtcagaagtccggccatatccttgatacataaggaatttgcacccatatcttctatttcttttgcaatctctttccagtagtccagagtataagcatcgcccaaagtatagctcagcgccacctgtgcatgaccattttccttgttggcagcttttacagccgtctgaaggtttcgaatatcatttaaacagtcaaagattcggatgatatcaataccgttggcaatggatttctgaacaaagtattccactacatcatcggcatagtgattgtatccaagaatattctgtccacggaacagcatctggagttttgtatgcttgaagcctgcccttaactttctcagtctgtcccacggatcttccttcaggaaacgcagagaagcgtcgaacgtcgcgccgccccagcattccacggcatgatatcccacctgatccatcttgtcgacgatcgggagcatctgatcggttgtcattctggttgcgattaaggattggtgggcgtcacgaaggacagtctccacaatcttaaccggctttttttctatgttagccattttgtaacctcctgaatttttctattatttcactccaaagattgccatgaatgtaccggctgcaactgcagtaccgataacgccggcaacgtttggtcccatcgcatgcatcagaaggaagttggtcggatctgcttccgctcccaccttctgggatacacgggctgccatcggaactgcggatacaccggcagaaccaatcagtgggtttacttttccatgagttaccttacacataatcttgccgaagataacgccggctgccgtaccgagtgcaaatgcaaccagaccgaggacaacgattttaattgtatccatattcaggaatgcctctgcgcttgtggtagcgcctactgatgttccaagcaggattactacgatgtacataagagcattcgaggctgtctctgtaagctgttttaccacaccggactcacggaacaggttgccaagcatcagcataccaaccagcggagctgttgtaggaagaatcaggcagacaacgattgtaacaatgattgggaaaagaattttctccagccttgatacaggacgaagctgttccatcttgatttttctctcttcttctgtggtcagaagcttcatgataggcggctgtataatcggcaccagcgccatgtaggaatatgcagcaaccgcgatcggtcccatcagtcctgtctgtcccagctttcctgcaaggaaaatggaggtagggccgtcggcaccgccgatgatggagatcgctgccgctgccttgtcgttgaatcccaggaagatagccatgaagtatgcgccgtagataccgaactgggcagcagctcctaaaaggaagctcttcgggtttgcgataagcgggccgaaatccgtcatcgcacctacgcccatgaagataagggacggcaggatactccattcatccaataaataaaagtagtgtaaaagtccgccgacaccactcgacgaatcttcaactgttctcataatatcaggatagatattaacgagcagcataccaaacgcaatcggaagcagtaagagcggctcaaatcccttctggatagccagataaaggaaaatgagggctacgaaaatcattaccatatttccgacagtcaggttcaggaatgccgtctgttgaagaagattagacaatgttgttgtaatgtattccatattaatccctccaaacggaatcttttatgtcccgtatttaccagtttttagtttaatgttgcgagtgttgcgcctggttctaccatatcgcctaccgctacattaatgctggcaattgttccgtcctgaggtgctacgatttcgttctccatcttcattgcttcaagaatcaggataacctggccgcgcttaacagcagttcctgcctgtaatttaactccaagaatcttgcccggcattggggctgttacggctacggagcctgccgctggtgctgcaggggccggtgctgctggtgctggtgcgggcgctggtgccggtgctgccggagccggagccgccgctctgggggccggcgctgcctttggagccggtgccggtgctgccttagcagcccctgtgaagccctcttccactgttacttcataaacattaccattaactgtaattgtatagtttttcatctgattttcctcctgattcaattaagcatttttccattttgagccagacttgcgtctgattgaacgaactaccagtccttctgccggaactgccgctgctgcagaaatagctgccgtaattactgcaacaagctccatatcatccgccagattctcctcttcataaacaacaggctccggaaccggaactgctgaagccgccggtgcgggcgctggtgccggtgccgcaggtgcaggggccggtgcaggaactgccgccggagctgccggtgcgggaactgccgccggagctgccggtgcgggaactgccgccgctttcttagcttcctgttttgccttgaaattcgcttccagcgtatttacattcttcaggctggctataatgaagctgatgaaaatgagtaccaggaatacggttcccatacccatcagtgtattcattgccgctctttcaagcttctcgcctgtagtaaagattggagtgaagaccatctcggttgccgcaagggaagtgccgccgtaattatcgctcactacctcttccgccgtaaggacaaaatcgagttctctctgctcatagcttgcccttaccgttattttataagtttcctcatccacacgctcaacatcctcagaaagaacggataccagtcttcctaaatctgctttagagctctgccaggaagtaatggcactttccatgacagtgttcttctgtttctgtaccctctttaatgtcgttgccagcgtttcatcgtcatagctgtcaaactccttcagataattctcggctcccgtcttcatcgtagagacaattgtctccggaaccggctctgattccttcttgctgccggagcaggcggtaagggcaaagaagcagactgccatacataacacaagcaatacttttttaatattctgtttcatatatgcgtcacctcatcataatcagaccgttccatgctttttagacggacgatcctctctctttgtgaataacatctcaaacgcggcgattacgcgttttcttgtctcgcctgcttcgataatatcatccacatatcctcttcttgccgctgcctgggcagagctttgaagtttttcatattcagccgctttctcactgataagagccgctgcattctccgatttttcaatctcctctgagtacataatcttgaccgcgctctgtgcatccatcataccgatctttgcctgaggccatgcgtatacaatatccgcaccgatggatttgctgttcatcgtaacgtatgcacttccgaacgcttctccgatcactaccgtaacttttgccacatctgcattggcgaaagcataggtcagacggcctgccgctttggcgattttcttctcagtacatgtgcactgtttgtatccttttacgttaacgagagtcagtaacggaatattaaatgcattgcagaaattaacaaattccgccgctttttcacagcctcttgctgataaagccgcatcaaactcttctgttttttcgttttcttcattataaatttcggtacggtttgccacacagccaaccgttgttccgttcaggcggataaatccggttaccatagaaggatcatattctttctttacttccatgaagaaataattgtcagaaatctctgccagcgctttggcagtatctccggtccagccggccagatctgcacaaaccctgtttaaatcgtcttcgcattcgtcataagacatgtcatcctcgttattagccggaagaattgatacaagagtcctgatctgtccaagaatctcatcttcactgccaaccatatcaacgaggcctgcctcctcactctggaactttgcagatgccgtatcgcacttgctcacgtcatttccagccagggcattgggagaattcacaaataacttgccgtcctctgccataaatacaaaatctgcgatagcagaagataccgccataccgccgccgcaatttccaaataccgcacaaatctgcgggatcacgccggatgccagtgtctgctccagatacatctggccaaaaccgtcaagcgcgtctgtcgcctcctgaagacgaagaccggaacaatctaagagtccgataaccggagctcccatcttcatcgccattttataaatgccggaaatttttttagcgtgcatttcgccgatcgatccgcccataacagacgcatcctggctgtacacatacacaagattgccttcgatggtaccgtatccggtaattacaccatcagccgcagtctcctgtgccgtcatgttgaaatccgtgttccttgctgtaacgtaagaacccacttcaacaaaactgttatcatcaagcagggattcaattctcttacctgacaatgtttgtgcagaattactcattttgctgtcctccatttgaattatttcgacaacggatactacctaccgtgaccccaaaaaagttcactttttagtaagtccaacttttgcctagtgccattgtataatgggttttgtcaaattgcaagttctttcagagagtttttatacacgttttttattttataacaactttttttcaccgaattttaagtatttctttaaaaacagcggccgcagagcgcagtccggtttgtttctccctgttttaacaatttttttgtaatttattattacgcagattgtccaatactattaatgaatttcattgaaatgcatcaatgagaatcatgaaatagggataaaatgaaaaagcatgaatgaaaggaggattaattatgagcccggctaacgacaatttggcaaaagaatgtacctgtaaacaaattcttgcaatcgcttccgttccaaagcagccctggatgcagccccgagaactctctcttgcgctgaaacgaggtacgatttttgaaaatctggactttcctttttatgtaggaggtgaacagaaatgacggacagaaccacacttttaaaagaaattgacgaggtaagcttcgcactgaatgatgtaactctttatctggatacccatccggattgtgcggacgccatctcctattttaatcagatggcgccgaagcgcgaacagcttttaaaagatttcgcagcaaattttgaaccgctcaccgtagactgtattagtaaaaacggcggactttccgaccatttcacatggctggacggacccgctccatgggaaggaggtgccctttaatgtggaactatgaaaaacggcttcagtttccggttaatatcaaaacctgctgtcccaagacagcttcattaattatcagccagttcggcggcccggacggagaattggctgcttccatgcggtatttatcccagcgttattccatgccctgtaaaaaagtggccggtctgctgacggatatcggtacggaggagctggcccacatggaaatgatttgcgccatgatttaccagcttacaaataatatgaccatcgatgatgccagaacagccggttttgatgcctattatgtggaccataccagcgccctctggcccacggcagcggcaggtattccgtttaatgcatgcgaatttcagagtaagggtgacgccatcactgatctgacggaggatcttgcggccgagcaaaaagccagaaccacctatgacaatcttctgcgcattattacagatcccgatgtgcgcgctccgcttcagtttctgcgtgccagggagctggtccacttccagcggttcggtgaagcgctggagaacttaaaggatacgatggattccaagaactactattattttaacccggaatttgacaagaagtttatacaataaagattggtaacagaaaagacagtatgaaaaccggaggaatacccaccctggcaaaacggcaggcaaatcctgtctgctgcggtgagtacttctccggctacatagcactttcttctattatataacgatggtccattccaatcctgggcatttgttactgttcacacctcgccaaaaagcggcgtgctgcaacaataacacgcttcgcgggatgttaccgtatgaacagtaacgggcatttaaacagttggaaaaaatatccacagcgagtttgacaaactactgcaattcatattatacttgcagaaagaagattgataaggtgaggacaaaggaatggatgcacgatacacaatttaccacgaaatgatcgatgagctggatgagtcataccgcctgatgcatgaatacgactcgatgatccacgattacggaaccgccgttctctatcaggcagaatctaagatcattcatcttgtaggtgagcgaccgggcataacagccgttgaactgtccgcaatactcaggaaaactcccagcgcctgttcccagattctgcgcaagctccgccagaagggatggattgaacagacgagaaatgccgataacaaccgggaatacaacctgactctcactccggagggatgggctatctatgaaggccataatcagttcgaacagcgctgttacaaacgcacctataagaatctggaagctttcagcgacgaacagctgcgcatctttgtggaaatccagaaaaagctgaatgaaacttttgttctggacgttgaggaaagccgtgaaacatccgccaaccggaaagccggaaagcagccctgatatcagctgctttccggctttttgccgctatttgcaatcagatgtaataaatcaatgtccgggcccctgctgtgacggcgtctgctgagcctgctctgtctgctgcgctgcgtctgccgtctctgccgttatcggtgtgcaaacgccgtctgctccggcctgatacttaactccgtcaagttccaggaccgtatttaccgccagggcgccgtttgccgtgtcaaagtaatatctggctccgcctatatcctgccagccggataccatcgcaccgctgctgttaaagtaatacctggccccgcctatatcctgccagtctgtcagcataactccgctgtcgtttaaataatacctggctccgcctatatcctgccagccggtctgcatggcgccgctgctgtccagataataccagcttccgttaatattctgccagccggtctgcataacgcctgcagaatccatgtaatattgcctgccttctacattctgccagccggtctgcatctttccttcgccgttcagataataccagactccgtccagattctgccagccggtcttcatagctcctgacgcactgaaataataccaggctccgtcaatatcctgccagccggtcttcataacgcccgaggcgtcaaggaagtagcgtcttccttctatctcctgccagcctgtctgcatctttccttcattgttcagataataccaggctccgtttacctgtgcccagccggtctgcatctttccatccgtgcccagataataactggctccgtccggattctgccagccggtggtcatccggcctgaaccatccaggtaatagcgtgctccgtcgatatcctgccagccggtctgcattcttccctctccgtccatataatatctggctccgttcacatccctccagcctgtagccattgtgcccgacgggtcaaagaaataccaggctccgtcaagctgctgccagtctgtcgccatctttccggtggaggcatctagataatagcgtccctccgggaatgtcatccagcctttggccggtgtgccgtcggcgctcatataatactgaccctggccatcattgatccaggtcgatttctgcattgtataattctgataataatatgtgctgcctccgatcgttctccatgtatttgccggaataacactggagaagtctttatacaggaaatttatgtccacgttgccgttaattccgttaatggagcctgtgttggtggcctgccacatggccggactgtcatatgtatacatgacgccgtatcttgccacccacatgtcataattcagcgccgacatatcgattttattcttgatccaatgctcattggcataaaccatcgggtggtatcccgccgcctcaatcttgcggcagaaggcattaatcaccgcactgacctcggaaggtgacaaagtgccgagtgtgttggcatcctccgcgtcaaacacaaccggataggaaatcggatagtccttaatcacattgagaataaaatccgcctcctgttcggccatctcaacggatgtcgcataggaataaatataggcgccaatgtcgattccgacgctgcttgccccacgggcattgatactgaagaagggatcctcagcccctctgaatcttgttgccagcatggcaaacttcacatcgtcagccgccacctggttccaatccacattctggttccagtaagaaagatcgattccccttgccagaacaccgtgaataggggttccgtccaccatctgatatacattgcccaccctgctccattctttcgcatatacggtgagcggctgtgaaaatacagatatccccagcagccctgccagagtacaggcagtcaaacgttttccatatttcataaatccagtacattcctttccgaagtaaattaactttttacagtttttcttctttcccggcagtcgggccgctgcggcagcataagtccctgcctccgctacgcgatcctcgcggagcattttttaattcacaggacatacgtcctgtaaaataaaaaaccggtgtttggtataatatagttcattgtacattataccaaacaccgtcagggtgaagtcaatatattatttgtgaatttttctgacacttttcttacaaaatatccagacatttacaggcagtcttcagccggacccgttcaggcgcctttctttgtctccacatcttccggccttctcagactttcctgagccgggacaagcacctgttcataatgctcgatcttgctgtccagcagatccagcgactcctggagatccttcattctttccaaaagctgggctctctgctcaaccaggatattcttacgggcatttaccgtctccgtcccctgttcaaacaaggctacatattcgacaagcgcctctatctgtaccccggccttcctcatgcacttcatcagctgaatccatttcagggaatcctcatcataatccctgattccgcttttcgtacggggcacaggagggagcagaccgatgcgctcataatagcgcagcgtatccgctgatatctcataatttttacttacttccgcaattgtcatggtatcggtatctcctctcgcgttttcgtccgccctgtccgttcctcgctccggcacacaggctctatgccttcattgtatatcaattaaaaggatttgcaaagctttactaccagattcccatcactctctgcagcagcaggctgactcccgtgattccgacccagcagctaaagcccataataatcggttttccccccgttcttatcagatcgacaatattggtattcagtccaatcgcagccatcgcaagaacaataaagaacttgctcagctcttttatcggattaaaaaactcaaccggcacgcctgcctggactgccaccgtggtgataatggatgcggcaataaaatagagaataaagaacgggaatatttgtttcaggcttacttttttcccttcggccttatcttccttttcctctttttccgttctaagaaaagcaaggaagagtgtaatcggaataatggccagtgtcctggtcagctttaccgtcacagccttatcaagtgttgcagaccccaggttccacatgctgtcccaagtggccgccgtcgccgtcaccgaggaagtatcattgactgccgtcccggcaaagattccaaaagcatttcccgtagtcgtatcaaacccgagaaaattaccaaacatagggaaaaagatggctgccagaacgttgaaaaagaaaataacggatatggcctgggcaacctcctcatcatccgcctcaattaccggagccgtggcggcgatagccgaacctccgcagatggaggaaccgactccaatcagggttgagatattggaaggaatatgcattgtcttatgtaaaacataggcaatcaccagtgaaatcgtgattgtggacacgataatcggaagtgactctcttcctgttttgagtattacgtggagattcagaccaaagcccaatagaattacggcccactgcaatatttttttagaagaaaaatggatgccgcccataaaaggcgatttatcctttataaacatggtaattatcattcccgccataatagcaatcacggctcctcccgcaaccggaaatatctttcctgcgaaccatgccggaattgccacgcccagacaaagaagcaatccctttccatttttttttgcgaattccatttcatttcctcctgtttttcatcttttcattgaaaataggtttatatgtatcccggctcgctgtcctgccgccggaggtacttcctaattcatgaaatatatggtaactcgccccatcgataatgtaaaattatatatatttatacttcaataaaaatgtgttatgatatatcaatacatttatataagctattcacagacagtgaacagcttatacatactgaacagcacaggacacaggaggaaattgattatgctggatttcagggttagtacctttttaaccgtatgcgaatatatgaattataccaaggccgccgaggcgcttcatattacccagccggcagttacgcagcatatacactatctggaaaagctgtaccacataaagctgttccagcacgacggaaagaagcttcttctctccccggccggtaaaattctgctgaggactgcgtcggcgataaaaagcgatgagcagtttatgaaagaacagatttccaggctctcgccctcgggccttgccctccgcttcggcaccactatgacgatcggggaggcggtaatctctgaaccgctggcctcttatctgagccgccatcccggcgacagcctcagtctgatcatctccaatacggatgatttattaaaacgtctccgcacaggcgatatccattttgccctggtggaaggcaattacgatacgtccgaatttgactcccacatttaccgcaccgagccgttcattccggtctgctctacgcgccacagcctcccgaatgaaccctgccggatccgggatctgttcaatgaacatctgctgctgcgggagcctggttccgggacccgggatatccttgagaaacatctggacatgaaaaatatccgcctctccgatttcacccatatcacggagattggcagcatgcatgtcattctggagcttctcgaaaaaaatctcggcatctcttttctctatgaggcggccgccctgcagggaatccaaaacgggaccctgcgcaggatgcctctgaaagattttgaactggatcatgattttacgtttatctggaacaggggaagtgttttttcagatatttatttgaaggtttatgaagaactgcgccggtatcagtaagaatacgcctctaacggagcagagggaggtttctttccgtatccattctaatttttcctctctttctttctcctgtcctctgataaaaacaagcctaataatgttaaaaagattccgcatatcatcgccttcgtcatcttctcgtgcagaatcagcgccgaggtgacggccgtaatgacaggcaccatatagatatagataatcgttttgaccgagcccagtattttcacggcataattccacgtggcaaagcaaagcgcggatgcccccagtcctaaaaagatcaggttcattagcataaccggttccaaaaactgatcaagcttcacatcgaaacccatccagaacagagccggtaccatcagaatgattccgtagaaaaaaatcctcctggtcacctgaaccgtgttatagccgaacccggtaatctttttcatcagcgtcgaatatgaggcccacagcaccgccgcaatgacggcaagtatatcgcccatgggattcagcttgagcgtctggccgctgtcaaagctgattaaaaagattccggccatggcaatcagaaaaccgcagaaaaaccttgccccgggacgtccttcccgaagaaaaacacaggtgaagataacggtaaaaaagggggctatggatataattaccccaacattagaggccagtgtataagtgagcgcgatattctcaaaaaggtaatagagcgttacgccgagcaggccggccagcacaaaatagccctcctgctttctgtccgccggtttaaagctcttcggacaggcacaccacagggccagataaccgataacaaaacggatgaataaaatttcaatcggtgaaaaggaccgcagaagtaccttcgtggaaatgaaggtggttccccagattaatatggtgatgaatgcggcgagatgccctgttaatgtcttattcttcattataatcctcccctgctgcagaaagctgagttcctgtatcagtaaaaatcctctgatactgtttcggcgtcaggccgataaactccttaaaaaaattagtaaagtgactctgatcagaaaagcctgccatgctggctgcgtcaatcggcaaaatcccctgttccaggaatttcttcgcccggttgaggcggaccgtctgcaggtagcggtaaggcgagactccgacctgtttcgtaaaggagcggagcagatacgatttaccaaagcttgtcatggacagcaggttatccaatgtaatattctcatcaaaatgctcctccatgtaggcacagagagtacgaatctgttcccccggttccgttctttttacctcatcaaagggctggacatactcctgcagcacctgttccagcatgaagaagaaagcctcctccttcttcatggacggcgcatgggctaaaattgcatcatatacaccggccaccgactgagtgatttcactctgaaagacgacattctgtgtaaaatgcggcacaaattctttgcctgtaatctcccgcactgccttactcattgcctcagggccgatgttgattcctctgtaatccagaagctctccgtctaccggcgcacagtaatgattatccctcggattaaaaagcagcagatcgcctgcattcagatcatattccttacccctgcaccagaggcggcgctttcctccctccacaaacccaaccacgtaatattcatggaaatggttcggaaatttctggactattccgcttaaattatatgcttctattttcaagtcttgatcatagtaaatatgacgctgctcctgctcctgaatcatggttctccctcctcatgtatcaccttccctgcagtaccgctatttcgtaaccgttcagacagaatgaactgttacgctattctatcactgaaaggaaaaaaattcttgtaagatatgacacataattgaattaaaaaagccggtacgccgcgggataacagtcggattcttttccttctgtcaccccggagcacaccggccggatcggctgttaagccagcccgattaatttctgcttctgtttaataaccgtaaaatgtaaaggaacagattgataaagtcaagatacagggacagggccgagaaaatagatgctttctctaaaacctcctgattttctgcaaaatgtacataattctgtctaatctttcctgtgtcataggcggtaaatccaaggaaaacggcaattcccacataacacattacggtttccatggctccgagattcagaaacatggataaaatcccaaaaataatcaggaaaatcagccctcctaccaaaattggcctgatgccgctgatgtcaattttaaaaataaggctgacccctgccataattccgaagaaaagtgacgttgccacaaatacgagaagcagctgaacgactccgaataccaggaagtatgccgaaaaaacaatgccgtttaacgccgcatagaacaggaatattcccctggccgcaccgacagacatcttattgactctggcagacatccagaatacggtgagcagttccagtcccgatattactatcagtccataaggtatcgcaaaaacaaacagaatagccccggtcagataccccgttacagcgattgcaaacgtaagcataaggcctgcaaacatccacagataagtttttgccacatatcttcccaatgtctcctggccgtatccttcggcctggtaaacctgattcatctgtccataatccattattatcatcctctctcttccattaatatcgtaatgctccggcctttaacggacaattacgtgacaatttattcctgtcaaggatagattaccacaatttcaaaaaagtgtctaccatttgttactgatcctcgagccttctccgtctttttctgcggagccgcaaaagaggtacgttgaatttttttaatgcgctgaagcaatagtagtaaataatgaataatacggttgtgattccccatgtcagcggataactgaatatgaccgttataatgctgggacggattggaaccgcaatgataatccagaccacccggagggtgcagacacccaaagccgtcatgatcatcggtatccagcagtcgcccacgccgcggagcgcgcccgaaaaaatctctatacagatatagaggataaatgtcggaacgaggaaatacaggatttccatgccttttgcgattactgcggcatccgttgtaaacagcagatatacatagccgccgaacaagtacaaaaccgtgcagaggaggaatgtgataagggccgtaataccaagacagacgttgacgccgcgttttacccgtgtcatcttgcccgctccgtaattttggcctacaaatgttgtgatggagatccccagcgcactgataatcatccagtatacgctgtcaatcttactgtatgccgtccaggcggcaatggtatccgttcccagagcgttaacactgctctggatgatgatattggacagggcatacattaccgactgcaggccggccggcagcccgattttaattattcgtttgaccatgaaaagattcagacgtatcttgcggataattagcttataggaatccgtcgtcctcatcagggcaaacaccacgagtatggcgctgacaagctgggaaaataccgttgcaatagccgcgcccctgacttccatccggagaaccacaaccagtacgatatccagcacaatattggtcaggcagcttgccatcagaaagtaaagcgggcgcttggaatccccgatcgctctcagaatcccggaacccatattataaatcaggttcgtgatgattccgataaaataaatatttaaataagagagagaataatccataatctccgccggcgtgcccatcgcttccagggctgtccggccgaaaagcaggccgatcaccgtcattcccaggccgcagacgagagaaaaggccatggctgtatgaactgcctcgccaaccctatcctcattctgcgcgccataaaactgggaaattatgacggtcgcgccggaagaaagtccgacaaagaagccgaccagcaggttgatcagcattccggtacttccgcctaccgccgccagggcctccttccctacaaaccgtccaacaataattgcatctaccgtattatagagctgctgaaaaaacgtgccaaacagaatcggaaagaaaaacagtaaaagctgtttccaaatcacgccctccgtgatagagccggcgcggctcttttttatctcttccttcttctgctccctggcagacaggctgttcatagcgcttctccttcttatcttttgttatattttactgtccgcagctctcacagttaccgccacgcaatgcgtttctatgaaagctcggcaatccttgtaataccgacataaatatgtgaaatcttataccaggtggcaaaatcaactacccctgtctgggggaggccaaaaaccgactggaacacttttaccgattcggccgtagccggtccgtatatcccatcaatcgccaccctcgggattgaggaatacacagttgcgatggtatcgagctgttcctgcatctgcctgaccttgtcaccgcttgaaccaatcgtcagattcgttcccggaaatgatgccggtattccggaaatcatctctgcggtgttaatgtacatgttgctgccataaaaatgtctgaggatctctatcgggctgtagccctgttctcctaaattgcaggacccccactgagtcatccatcccggacaggttacctgtcttccgtcacagtactgagtcaggatcggctgccttactcccggtcttgacagatagctgtcgaaaatatcatcgaccaccacggagatcgtgtcaaagatatctcttccgtaaatccacttatgatcaaaagcagtggacgaagtaatcgtaaagtcgtatccctggttcctgtaccattccgtgtaaaccctgttgagggtaaatgacataatcgccagaacattggctacgattgtggcctggggccatgtcgcataaatttcactggacgccacattcttgatataatccctgtatgggacataataattctttgccgttgcatcggtcgggactccgtcatgtaccacgattgtctgcggaaccaccacacggcttaaaacaatctcgccgctttcattggtcggtttaatctcctcctcggcaattttcggaggatacgttccgtaaagtgtatgatcagggatttcaatgtcttccatcgtcccctgctcttctgcagccggtatcatccgtatcggctgaatcgccgtaacgccggccaatatctccgttccgtttaccgtcaccggttcaaagccgggagccgtcacggtcaccgtatactctgaatacggtcttatcgtattctgttcatccagactcagggcaacgggaggcgctttcacggcaatggattcggtctggccggaattgttggtttgcactacctcctccggtgcctcctccccctgataccggatcaaaacatcggccccctggattggaaaattattctcactgtttaccacattgacctgcagatatccctgttctgtttcagatgcttcacaggcatgcaggcttttgtaactgcgtccatatctctgcattaatttgtaacctctcattacagttggttactatatcatataaaaataacgcttatgatatgcctgcggttctcagatattgttagcgtcagatttcccgcgtcaccttctccagccatttcgcctcttcctccggcagatatggagagatcttattataaacttctttatggtaagcatttaacagctcccgatccctcggctccatgtattttacatcgatggcatcgagatcgatcggaacccaggtcaggttttcaaatttcataaactgggcatattcattcttctctgcctttacacagagcatcaggttttccgtcctgattccgaatttgccctcgaaatacaatcccggttcgtcggaagtgatcattccctcctcaaacaccgcattatcctgacgttcaggcactacgcgccagcggactccgttcggacgctcatggacgctgcccaggaagctgacgccgtggcctgttccatggttaaaatcaagcccccttctccaaagcagttctctggccgcaaagtcgaaattataaccgtggcagccgtaggggaatttgacattcaacaatctcagcatacaggatgcaaccagggtgaagcattctttctcttcttccgtcagttctcccagggcaaaggttctggtgatatccgtcgtaccttcaagatactggccgcctgaatcgaccagatacagtccgcgcggcatcagtttcttattgctctcctccgatacggcataatggcacatcgccgcattgtcggaataggcggaaatcgtaccgaagctgaggcccagattgccttccacttcacttctcagcttatccaggtaagcggcggctgtaatctcatctatctctgtcttacctacgttttgtttcagccagtacataaatttcaccatggcaacgccgtctttgatatgcaccttcctcatattctcaatctcaaccggattctttacggctttcgcagaggaggtgggattcatcatatcaaccaccgtgacgctgttatcaaggctctggcataccgcataattcacatgcgctttttcaagcatcaccgtctcatttttaaaggaaggcaccacctggtagatgtcattgtaatcataaagtttcactcccagcccggccagataggttctcacctcttcatttaatgtctcctgattgataaacaggaggatttccccccgtgtgacaatcagataggataatacgaccggagtacagggaacgtcattgccgcgtatgtttaaaagccagataatatcgtcgaggctggtcagaatatggacacccgcattcttttcagccattgtgcttcggagatccgctattttttccgatgccggcttaccggcatatttatcttccagaatccacaccggttctttcggaagttccggtctgtcttcccaaatttctccgattaaatcttcataacacgcgatacagatttcttttgcagcaagtctgtcctggagttcctctcccatcaggccgccaaccacgcggccgtcaaaaccgagaacgcctcccatggtcatggtctgctccaaatattcctccacagtgggaacgccttcttcccccattttaaacagctttacttcacttgtggcaagctccttagccgcctgcacgaagtagcggccgtctgtccacagaccggcttcctccattgtaataacggctgttccggcagagccggtgaatccggttataaactgacgcgccttaaaatagccatccacatactcagaaccgtggaaatcggccgtagggattaaataggcgtccatccctctttccgccatccgtttcctcagtgccgcaattcttgtaccgactgcttgttccatctttgttcctcctttattatcctccatagctttttaatgcatcctctatggcaagcgagatggcctcgctgtatgtcggatgtgctctcattgccgtggaaagctgatatgcagttaatccgttggcaatggccgtagccatctcgccaatcatatcggtggcacgcggacacataatctgcgctccaaccagggtatccgtatatgcttcaaaaataagccgaataaagcccattttctttctcgccagaatggccttgccgttgatacccatgaacgcctggccgcatttaaccttcatattatattgtcttgcatcttcctcggtaaatcctaccgccgcaatctcaggatcggtgtagatgcaggtcggcactaccggcagcactacaaacattccgttgggaacgacggtgagctgcattctgtggcctttcccggtcaaatgttcaatcacgtaggtggcctgtgccgccgccacatgggcgagacgcgtctttgcgaccgtatctccgatggcatacacatgctcctgtgttgtccggtaagtccccttgactatcggcctgccatgctttaactccacccggcagtcctccgccagaaccttcgtcatatccggcctgcggcccacggagagaagaatccggtcggcggccagttccttccacggcccttcctcgcggtagctgacagcaacgctgtcaccgccccggctccggatctccatcacggaaacgttgcattttacgtcgatccctttggatcggagcgattcttccaattgctccgatatcatcggatccatcgtatccagaaggcgcccttttttctccagcagggtaaccctggaacccagcgcagaaaaaatcgtggctacttcaatgccgatcactcctcctccaataataaccagcctgtcgaagtgccactcaccggcgcttaagatatccctgctggtcagcacctggggtaaatccactcccggtatatccgggattaccggctcggctcccgtagccaatataatattctttccgacacagagggaggagccttcttctccctccacctcaacaatattatctttatgaagctttgcagtcccatgaatcagttttacattcctacggttcagaagggaacgtatcatactcctgtactcctccaccgactcatccttatatgcctgcatcttctttaagttaaatccaacagaatccacgctgatcccaaaccgggaggcatgttttaaatctccgtaaacggcggatgcctgcagcatggctttcgccggaacgcagcccgtgttgacacaggcacctcccagctcgcccttttcgattaaggccacattcattccgaagccggccgctctcgctgccgccgtatagccgcccgggcctgcgccgattattattacgtcgtactggtctgccatcagctcccccttgccctgctgttacagcagatgtattttatgcttctccgcttccatccgtattccgtcgggccatatggatgcctgcacttctccgatatgggcttttcgaaggaagaacatacagattctggactggccgataccgccgccgaccgtatagggaagctctccatttaagagcgccttctggaaaggcagttcagcccgctcctcacagcccgccttctttagctgctccttcaatgcctcctcatcaacacggattcccatcgatgaaagctcgagtgcaatatcaaggaccggataatatacaataatgtccccattcagtttccagtcatcataatccggcgcacgtccgtcatgcttttctccggaagccagcttatcaccaatctgctcaatgaaaaccgccttgtgaagcttggcgattctgtactccctctctttcggcgtacagtcgggatacatatcctcaagctgctgggtcgtcacaaattcgatatgatccggcagatatcttccgatatattcatactcataggccatataatcctccgttactttcagagccttatatacggcctttacgatcagctccagattctccctgtttctgtcttccttattgataatcttctcccaatcccactggtctacataaatggaatggatgttgtccgtgtcctcgtccctgcggatagcgctcatatcggtgtaaagaccttcacccacgccgaagccgtactccttcagcgccagacgtttccactttgcaagggaatggacaatctcggcaggacgatcctcctgctccctgattccaaattgaaccgggcgttccacgccgtttaagttatcgttcagtcccgattcgggcaaaacgaacagaggggccgacaccctggtaagatgcagctgctttgccagctccctctgaaaaaaatctttgattatcttgattgcaatctgggtttccctaaggtcgatcgccggttcatatcccgccggcacgattaaatgttccattttatgtactcctgttcttttcttctatataattttatatatcttattcttacagacatattattagcagcttttgttgatattcgtcccactaagccctcatattataccactgatataaacaaatgggaatatggcagaatttttttcttgctttgccgaaccttgttgttcctgctcataacgtaatcgattgcacgacgtttttaccagttgtacggttaccgttattatacatatagaatgcttatctagcaagaagaaaacaggcaaagcagacatctgtggcggatgtccgctttacctgttcccctgattcttctgacctctttacagtctcagccaggctacttcgtctcctgccgtaaccgggccctcttttaccgactcaattccctgtccgccttccagtccggttaatacgacaatacattgatccgacgcggcgttctccctgatatactccagatcaaaccgcatcagcaaatcgcctttttttacggtgtctccgtccctgacgaatacttcaaagccctttccatccagcttaaccgtatcaatgccgatgtggagcagatattcgatgccgtcttttgtcttcatgccgacggcatgttttgccgggaagacaaatttaaccctgccgtcctccggagcaactgcctcccccttctccggttcgaccagatatccgtcacccatcattttttctgcaaaggccgtatctgcggccgctgatattggatatgccttcccggtaaacggagaataaagccttcgcagcgtacctgcatcctcctccaagccggcgccgtttttcaggtattcctcaaagtttgccttgatcactgtgacattcggaccataaataatctgaaccgccctgcctcttttgatcacgccggacgctcccgtccttttcagcacatcctccctgaccttatccgaatccagaaccgtacagcgaagccgggtggcgcagcagtctacgtcggaaatattatcttttcctcccagtccttcggcgatcatgcgctcacgttccgaactctcctgtccttttgacgccgctcttttgccggcatttttcttctcattcacatccgcttttgtatatagttttgttccctctcccgaatcctcgcgtcccggtgttttcaggttgaatctcttaataagaaaactgaaaataaagtaatataataggaagtaaatgattccggccgggatgattcttaaccagcttgtttttgcattgccctgaagaattccgaataaaagcaaatccagaaaacctcccgaaaaagtcagtcccactgctatattcaggatatgggcgatcatatacgcagaaccggccagaataacctggactgcaaacagcaccggcgccacaaagaggaatgaaaactctatcggctccgtaatacccgtcagcatacaggtcagcgcagccgagagaagcaggcctcccgccgtctttctgtgttccggctttgcctgtctgtacattgccagcgcggcgcccggaaggccgaagatcataaagataaactctccggagaaatatctggttgcgtcagcgctgaaatgcactacatccggggaggcaagctgtgcaaaaaagatattctggcctccctgtatcaggttgccgtccaccatcatcgtacctccgaccgcggtctgccagaatggaaggtaaaatacgtgatgaaggccaaagggtatcagcgccctcttcacaataccgaaaatcagggttcccagatatccggttcctgtcaccagccctccgagggcaaaaattgcattctgaaccggcggccatacaaaatagagcaggatcccgacaaatacatagacaagtgtggaaataatcggcacaaaccgggaaccgccgaaaaaggaaagagcattgggaagcagaatcttatggaaccggttatgaagggccgctacccccagacccacgataattcccccaaacacacccatttgaagtgtctgtattccgcacacgctggcaatagtaccttccagcacatccggggagatgcttccgtccggaagtattttccccgtgacctccagtactgcactgattgatacattcatcacaaaaaaagcaattgccgccgagagagccgctacctccttttcagcctttgccataccaatggcaacgccaatggcaaatatgatgggcaggttgtcaaatatggcgcttcccgccttgctcatgattaccaggaggccgtggaggatcgtgccctccccaagtatagtccccagtctgtaggtggcaattgtcgtctcatttgtaaaggagcttccaattcccaacagcagccccgccaccggcagaaccgcgatgggcagcatgaaactccgcccaatacgctgcagtacaccaaaaattttgtctttcatttctatttccttattcctttcgcttaagtctttaacactactagtatagccatctttttttcaaactaacagtttgcaggccatgccgcatacaggtgcagacttacagcgaacgataacctgcgcgctacgcgcatggtcacggtcttcaaaaaaaaggcatcattaccagtaaatgcagtttacgcatttactggtaatgatgcccgtaccgccagtcgatcaaagctcccggctcagccattgccgctcgaattcctcagcggcgacaggaagtccgaaataaaacccctgaatcaattcaagtccggtatcacgaaccgcccggtattcttcttctgtttccaccccttccagacaaacctgcttccccacgttgtggcaaagttctgtaatcgcaccgataaaaatagcattaaaccggtcttctgttattcccttcacaaaaccgcggtcaatcttaaccacatcaaccggaatattcttgagagacaaaagtgaggagtaccccataccgaagtcatccattgccagagtaaatccggctccatgcagtttatccagcacattttcccggctctcctcctctttcatgaaataggattccgtcagttccagcgtcagactggagggtggcatggcaaactgctccagcttcttaagcatgtccggaacaatatcccctttgcggagctgatggtaggaaacattgatgctcatcctgaaatcaggcctgtatctccgccatttaccgcactgtgcggcggcctggctgaaaatccagcggcccaactggttgattagtccgctgcgctccaaaagcggtataaattctcccggcgatatgctgccatactttccgcaggtccatcttgccagcgcctccgcgccgaaaagcttccctgtggccgcttccacctggggctggtatgccactgaaaaaccggcaaacccatgctcgatgctctccctcagtaactccatcagttccagccggcgctctttctccggaagtatatccggtgaaaaacaggtgattctgtctttcccaagcagtttggaatgctccagcgaatagttggcgcatttcacaagttccagatactggctgccatcctccgggaaagcggcataaccggcggaaaccgtacagtaatatttttttccttcgaactcctgctgcctgtgtatcttatatcggattctgttaaatatctgaatatgctcatcccagtcgccgttcagaatgaggatggcaaattcatcgccgtccagcctgtacattcttgcattggacggaagaagtgaggaaatcatctgtgcagtaacccggaggacttcatcgccaaaggagcggtcgtagagatcattgacgtttttaaactcatccatatcgagtatcatcagaccgaacttcctgccgtcatctaccaggtgctttttcacggtgccctccagctcataccggttataaagccccgtcatatgatcgatcaggtttttctttcccatgttggtaataaaaccggcaaaatattccggtttcccctcattatcccgcaccatcctgccgcggcaccgcagccagcaccattctccgaaaacgtttctggccctgtattcaatattatggtgctccactctgccgtcggcaatatcctggttactctccaggaatccctttttatcttcgggatggataagtacgccccatacggcggcagcattctccacgatctcaccgggcagcccgaattcttccaccatggccgcgggataccggaatatgcctgtcttcatatctccgataaacacataatcatcagtactggaagccagagcttcataaaggaactccctgttgtaatcaaaaccgggagctgtcctgcccctctccgtattgcggcgcagcctcatccccgcccggtcaatgcggaaattcctcttctggatgtacatccgttcatcggcccgggttataatctcattaacggaaaacttgtcgctcggataaactgccgttaccccataacagaaagaagcatcgtaatatatcccgaactgctcccgctttttctccagaagttccagcgctttctccatcctttcggccgccccgtcttccgtttcatcataaagagcgagaataaattcatcctcgctcagcctgaaaagcaggtccggctccgtcagcccctcttcaataattttagatacgtataaaagcaggttatccccctcatgatgtccatatgtatcgttgataaggtgcagtccgttaatgtcataaaacactacagtcagcatcttctgctcctgccgtgccagctctatcagctctgcaagcctgtcttttccgtttcttctgtccataatttgggtcagatcaacgaccctctgccattccactgtccccatattgtctgcctccatatggctccattcttccgggattaccaaactctccgatagctttcggaccccggatttatactctaattctattgtaatctttatttgggcggcagacaaggggaatttggatattgttgctggtattgcagtttagatgatttcataagagcttacctgtcagcggcggctggtatgatattctaaatgtgaaatcacgccaagcataacgcgaataaccagccagccggcgaatgctcctaatgtattcatgatgacgtcgtcgagctggcagtgtccgcgctgtgtcagatactggaccgtctcaagcgacacactggccagaaaagcggtcagaacgcagagccagcctcttttctgcattggcgctatcagcagaggaagaagcattccccaggggataaacatgatgatattttcaatcacataggcattcccctgggcgctgtgcccccaggtccccaaaaattccaggttgacggaggttctggaaccgggcggacgcgagaaaaatgcctcctggagcaatactgtcaggtagacggcaaataagaacagggtaaaaatgagaaaggcatgtcttcctgcactcctgctgcggcccggtaacggccctttttttatcctgttttctgcaaatagaagaaaagagccggcagcggcggcggccaggccgatgagaatggcctgaggcagatagcttaccggttctttcatgtcctggaacatgtaattccagagttgtagtttgcttaagattgtcatattttgattatttccagtctggatcgaattattccggcaggtaatcgctttctttgtaaaggaagcgaatctgcctgatgtggtatttacttattatagtgaattgaaggtggagagtcaatatagtatgggccagtcattattcagccggccctggaaattctcatcttgcccggctatcctgacagcttggtatttaatatacgtaatttttcgtaatatcaaaagcaaggaaaccaggaagggggtacaaagcacagcaatgatatcctgtttatcttatcccttcccaattttcttaaaaaaatcttcctcctctttattggtgttttcatcctcgtcgggcaatcccttaataataaaagctcaatcaatctcacaaatcagagtacagttcttcccgatacacgccgtcttcaatcagcttcccaaaactctgaaccacagccgctttgtcttccttatacgtgacgccaaaccacttgtcctttgtctccagcacctttaccgtacacttcttctcccggagcatgccgccgatcagagtcggaagcaggtactctgctttcagaggattccgttttacatccgtcacaaagaaagtcttaaattcctcttccagcactaagagaaatgggggaacgcagccttccttcgcaggaaagccccagaagttcatggaaacataggattccggatcgagtttaacgccatccgtctccgcacctatgtttccattgttgtccacagatttcacaatattgctggtctccaccacattaatgatatgtgtgtggccctctgccactttgcagacgcccctggtcacaccgccattgtcggacaacgtattcttcaaaataaaaccggccatagcgatagtggaatcctcgtgatccaggagcagccagtcatgcagttgccggaatgcctcttttccatagtaatcgtccgcattgataacggtaaacggttcatggagcaagtcctttgccgcaaggacggcctgcccggttccccacggctttgaccggcctgtcggtacatctaccggcacgttgttcaagtcctgaaaagcgtaggcaatttccacatgaagcgctttacagatcgcttccacgcggttaccgatccgttcacggaaatcttcttcaatatcctttcgaatcacaaaaataatcttattgaaaccagcctcgattgcatcatggatggaataatccataatgatctcatcgtgtaaaccgaccggctccagctgcttgataccagttccaaagcggctgccgataccggccgccatgataagtaatgttgtggttttcattcttttttgtcccctttataatttatccaataaatggtatggcagcatacccaccgaacactaaagattcagaatcactttttgcttagcatatctatgacaacactcttgagacgctttctctttataattaacaacatcaaagcacctgcaatgaccacatacttaagccaaagaatgcggttaagaaacattatagcaattcctacacaaatctcaccaatagaaattagtaaaatacccttggcatcatatagtttttgcccatccaacagttcacgacacactttcctatagaaaaaataatgcagcagacaaaaaaatgcataacaaaaaaatgtcgtatatgccgctgcctgataaccgtagagatttataaagatataattcaataccaggttgagaactgcacatagtattgagggaattaccaccatcaatttgcgttcataatattcctgcacccttgcaaaaagctgaaacgtgtaattgaaaaatacgcctatacaaattgggatgagcacatctacgctttctatgtatttcatccccccaaatataagaacaatttctctgctgaagatcattatccctgcaagcatggcacctacaaatatcagaacttcattcgctctttttgccaacaatgcatattccccagactttattttctggtattgataaggcgcaaatgtagaattgattgcacttgttatcaacgtaatcagtgatcctgctgaataagcaacactgtacaaggcaacatctcttgagccacaaagataattaatcattattttatcggaactttgaagaataaattctgaaagatagtgcggcatcaaaggaatgcagaacccaagggcaaaaaaccatatttttttctcataaaagacttttgccctgcggaagatagatgcgtacaaggcaataccaatcaaagaaacaaccactactgcagacactgctcttgcctctgcggtaggagtaataaatgttactgcaaataccccaaaaaaagcggaccctgctgtaagcagcagagtaataataataagacccctgtaatcatacacataccttttatataatgaccagcattggaataccgcctgaaacataaaataaacaaaaaggcagcaaacaagaaccggagataatcccagcaattcccctatcttttctctgaaaatcacacctataaccagccatataaatgataacgtaaattcaagaccacagacggctgaaagaactctctcctgatcttcatattttatatacagattcataatagccttgtacaaacacagtgtaaccactatcagaaggacagactcccatgacaaatatgtactatacagaccatattcttctgtggacaacaaccgtgtaaataccggggtcgttatcatactaactccacgctgcagaaaactacaaaccgtgaaccaaaaagctgccttgacaggtgcagacatcccaatatatttattttttaagccaatcaatgcacctttcatttcttttaccttcttttaattattcacttagaaatacctgtagttcctccggggtgccaaggacatgaaccttcgcagcatctacaatacttatcgttaccggcattcccttctcaatcataagattatacagtggtgcgatatacttctcattcttctccatttggctgtcatcggaataaaattcctcatacaactccctgtaaagtctggccgatgaaaaataataagctcccagcgtacagttatccgaaatgcgtaccttctctctgacctcaacaacattgccactgtcatccagccgagcaaaactccaatgattcccgtctgcgtggaagcatggaatatgtccgtctccagaaagatccttatacctcatttcattcggttccacatatgtatcaatgttgtacaccataattgcctcatctgcgttacagtgcggaattgccagcatacaagttgtagcctgtccatcagtcaaataatccaattctacaattttgacatcttgaattccatatgatgcacaatgctctctaataaagccttctgcatgatcctctgcccttacaacaaacacatatcgatttacattgttattgtaaccaaccaagctatccatagaccagtcaaacaatgtctttcccttcgcctcaatcatatatttcggacaataataccctgctttacggaaacggctgccaagacccgccatcgtaattataatattcatttcattcacctatcctgttctcttactatttttcctgctgaatcaaacttttttgttcttttgagacttattacctctatcaatttttacatttagactttctgcatatatcatccagttcttcaacactacgcgtgagaaattcatccggacgaactgtccgatcgtccacataaaatcccttatgccccggccatggctttccataaaaaatctcatcatatggaatatcccatttatctaaccattccaacagcacttttgctgtactcttattgattttccctaagtttccgttgtaggaattcatattacgggaggtaaaaagaataatttttgctccgttttcatgataatacttgagtttatcgaccatgtcctggtatggaaccaaatctttataattctcttccttcctcttaatcgggcataaagttccatcaatatcaaaaataaacgagtattcactaaacatctttattctctccttctacctgtatattaacaactctattcagaatctctaatcccgttccaagcattaccatctgatgctttatactttcgctgtgaagaggaatcatgctcaaaaatagcagtgcttctatcatttcaatctgctttaaactatttccgatttccgccttaaaggtatcaataaagactttgtataaatcaaagtctcttttttggtcttgaatacaataatcaatacgagcccttttataatcgaagttcacatcgaaaaggtctttaattatgaaatcatatttgccatccacactgtgaaaaagttttgcaagttcataacggaaatctccataaatatcataagttccaaacttcccacgaggatcaatgacttttataaaagataaattagtatctaccataatattggcaaagcacaaatctccgtgaataatgttaaaagtgtctacttcgtataacatcttagggataactttttccaatacggcagaaatatcattcaaaggcaaatatttctccccgtttacttcgattggctcttcaaaaaaagtcgaaaatatattctcttttttcattctctcgaagcgctgtaatgtctttgtcaaatacatctcctccagtgcgtgctggatactcccgtccttcacagtataacgtttgaaatcatcacacacaaaacgaatgcgattaaacacgtccacccactgctgcaaagttaaatcaccatagagaaatagctcgtgtaccgtgtgatattcgtaatactccattgaaacatatggatttacataagatgttgaataatcaaaaattctgggtcttacatattccacatcggaaggcaactttaaataccatttaatttcacctatgaacttatctttatcatcgctcgtttttcttaaaatgcctcggttcttatcaattgagatatgattaaactctctggcacgcacttccaatttagagttatagtacttatcctcatggccaatatcaaaccagttttccgtggaaattgccttcatcggatgttgtctgctgtatatttgtaaggcatggtagaacgtactcatttgagggcgtacttcttgaaatgctttttcaagacttgttttaaaatacacgggatcttctatctgaaaaactccaacaaacaacttcttctttttatcagtttttgcaggctttttatcataaatgcgtgtaatcacgccatcttgctcatcaaaatatgtccatgtatcagacatatagtcttcctggtaaaaaaaagcgtcaccatcaatctttgcaatgttgtccattacaattgtatctgaaaagttgataatcagcgattcctttatctggccaagtgcaaaatatatcgtttgtcccaaatcccccaattctgggagtatcttgatacgtacttgttcactgaggtaaggattgagccttcgctgcactttacctgcctgttcaaagcaaataatatccatcgacgtacaatattctttatattcttcatacagatagtcgaatgcaatcttttggttgatgggatatataattcccggaagctttccaagtttttggagttccgccggaacaattttagctgccggaataatgactcttttcagattgtccatatgcttcctcctcgtataataagtttgtaagcaagaaaaaccgcttacagacttattcttttttgggtataaatggtaaggatatctaagaggtactcccctcatcccgattcccatctatacagttgatagttacatttcaatataggtagatcctgtggtatgatatcaggtagagtctgatgtccgaaggcactgcttctcctcctttcagccggcttcgtccgagactgctttgaaagcattcagcctggcacatacggcacattccgctgacacagaattttcatccccagccgttagccccagcaaaaaaggctgactgggtgcatgctcattgcgcgagggttcggtcaccgtatgcggcacaggataaaccttttgcttcaggcttcacaaatccccatcggaatggaggtgatatcatgttaaagctcaactatatgtccaccttgtttgtaggtattgatgtaagctcaaagaccaatgctgtctatgctatggacttcgaggaaaacaaatacatctcatcatcgtttggcaataaccagccgggtgccgataagcttgttaatatgattgctgagtgtatgcacaagcataaaaacctgaatacgattcttatcgtgctggaatccacttctgtatacagcgtccatatttcaaacttcctatcgaccagcgaggttctcatgccctacaagccttacgtcttctgtgtaaacccaaaggccacttcgaattaccgaaagtcctatatcggaatggaaaagaccgatcccacagatgcatatctcatcgcagactttggcagggtaggccgtacgaaaaaactggagccatggcgcggcgggcagttcatatccctgaaacgccttacaaggcaccgtatgcacctttctgagtgcatcaccagggagaagacttatatggtttcgaatctttatctgaagttcagtgaacttcagctccttgaaggtgatgacaagccttttggcagtctctatggtgccacgtcctcagctgtcctgacggaatttttgtctccgcaggagattatcgatatgccggaagaggatctgcttaccttccttgcggggaagagcaggaaccgcatctctgacctatcaaaaacttcggaactcctgcgcaaggcagccagggattcctaccggttagacaagtgcatgtatgaaccactgagcatatcactggcaagctcgtttaactgcatccacgcctatcagaaagaaatcaagctgatcgagcaggcgattgagaaatgcatcaacggaatgaaccctaacgccctgctcatccttcaatccatacctggaataggtccgatatgggcatccggaattctatcagaaataggcgatataaccgtgttccattcatccgatgcccttgccaaatatgccggcctttactggcctaagggtgattccggagatttcacttctgaggacaacaaaatgtcgaaagccggaaatccctatcttcgctgctatcttggcgaagcggcaaacagcgtcaggaagcacatccctgaatatgctgatttctatgccagaaaatatgctgaggtaaccaaacatcagcacaaaagagcactcgcgcttacatctcgtaaattagtacgactcgtttttggattgctggtcaaaaaccaactgtacaccggcaaaaagctggacaccgaatataatattgagtcgaactgacattcggttatacgtaaaatataccgaaggtctgttaaagttacccttttttctgaaaaacatatcaaaatcttcttcaaaaagttcttgacatatcaccagaatgctttctttttagttttatcaataaatagcatttgctagttattgccgtaaggcatttgcatcatccgagttctgtcagatttccttgtagaacagttctatgatgattcgtttcaattcatccaggtccggataatactcatcaaaattaattgtttccactgcctggcccggtattgtcaaaaaatctttatctcccagctcctgctggctgttcaggaccgccatccccatatcgaggtactggtctttcgccatattggtaaccatatggttctctatggcattgacaagtcttgttatcagaccgctgtctttttccgactcttttttgaccgtttcaaaataggcctgtatatactgctgctgcctgtccattctgctcagagccgtctgcggcttcgtaatatcgcggtaacgtacaaataattctgcctgactgccgtttaggtgtacgatactcccttttttcagcagcgggtcttttacttccagcccatcctcttctatcgtgacggtaactcctcccacctcgtcatttaagagggggatggaactaacattcattgcaagatatccgtccagacggattccaaagcataaatccgagacagcggccgcgagaagcttacagcttttctctctgccgtctccataggcaaatgcaagggtaaggtgctgaacatctttacccagctcattgcccatcaaatcaaaaagcgttatctccgtcatcgtgtcccggggaatcattaaaatcctgaccgtatctctggccatatcctgcgccacaagaaaaaggccgtccgcctgccccgctactccggacgcggtttgctgctgcatatccccgctcgtatccacgccaatacagagaatcgcgcgaattgaagtgtttcttctgtatttttttccgtccagttcaattattccgtttgagggcgtcccggcaagtccggaggctttggctgcattcccggcctctgtcaatcgccgcgctttctcctgtgcatagtaacggtatgacaacataaaaatggcagcggccgcacaaaacaccgccaatacaaccggccatttgcttattgcttttcgtttttcccggatttgttttttactatccggcgcttccttttcagccgggccgttcttaatgtcactcatctttcatttttctccatgacggctttctgccgcagccttgtattttggtaacagttcagccatgatgtattccgcgaggtgttttcgctgttttttgcgaaaatcccgagttgtgcggcgcgacgcgatgaaaagtaaacttttcaccacaatcaacggcgtttttgccgtttctgtgcatcatttgttacggtttagctgaaggctgaactgtaacatatttttaaagctctgtgcgtcttaatgctcgctgctatactcttttccataatatttcccgtattttccgtaataatagtaactgttttgtctgacgtccactttatttaacaccgcacccaaaatccggcatccgctcttttccaactggcctttcactttttgcagaaggcggtggctgatattgccgctctcaataaccagtatggctccgtcacagttccggcttataatcgcgccatcaatcaggtttcccatcggaggcgtatcaattatgacataatcaaaattctcccttgcccaggcaactaatttatcgaaaaggggttctgccaacagctctgccgggttcggagaatagggaccggaaaaaatcatggtcaaattaggcagattcgttttataaactacctcttccaattttttctggccgctcaggtattgggacagcccgtcaactctccggtccaattggtatcgtgtgacaaggatcgatttgcggatatcggcgtcaatcagaagaaccttcttatccagctgtgccagcgaggccgctaaatgaaaagtggtctcgctctttccctctccgagaacagaacttgtaagcataacaacctgaatacctgtgcctgaaaactggatattcgtacgaagtgttttcatcgcctcattgtactgataatcttctattgccgttctttttaaaaagacttcgttatccatttatctgctcctcctcttttggcccttttacttctttcctgatttcttccttcctggtttctcccttcctggtttctcccttcctggtttctcccttcctggtttctcccttacccggctctttcggtgatttatgtttttcttttttcttgcccttctctctctttttgggaataacagccaatacagggatactcaggtatctttcaacatcttcctcactcttaacggtgtcactaaagacaacacggaccgctatcaaggcacagattaaaaacaccgccaggattcctccaagtagtgcatttctctttatgctggggctgtagggctccgatgccaccacaccgtcctcaatcattttcggcggtaccatttccatgatttccccaatgtagtcggaagcggtatttgcgatatcatccacgatctgcttggccatatacggattctcatcacgcaccgttaaagacaggattcgcgtattctgcggattctccaccgtcagctttccggccagttctttgtaagaatagtctaatttgagatggttaatgacaccctccataaccggccggctgctgaccaaaaccttgtagtcctgtgtaagctgactgccgatttgaagatctgccagagaagtcaaagttgtctccttcgataatatgtaaagcttcgcttctgatttatattgcggggtgattagaaatgcgctgccggcgccggcaatgccgattccgagaaacagggccacaagaatcagccataacctttttttcagctcaaacagcagttcccggagatcaatctctatctcttctttgtcttctgtgtacatcttttccattttccagattccttttcttttttaaattaatcttatctatttccatcaagcaggaattagcttactaaaacagttccccattcaggagtttctttggctgataataggtcagccgctcaaatgtctcccttttgcagtcctttagcagccagtcaactgctttctttatttcaggcggcctgtagtccagccggtgcatatcggaacccagcagatggatatttccttttttcactgcttttctgcaccagatacgatcaaccggatggttgattcccgacaggctgctgaaattcatctgcatataagctcctgcctgaatcagttcttcaatgcagccgcttttcctcagacaggtgaagcgttcaatatgagcgagtaccggaatataaccggccagagtcagctggcgtacggcctgatagatctctttatatgaaacagtagttgaaaactctatcagaacatatcttgtaccccccagcgataaggcccttccggactgcagcgcttccacaataccatcgtggtagaatagttcttcgccggaatagattgttaaatccggggcaatttcgcctgccattttttttactttttctaaggcgtccagaatctggcctgcgctcattttattatgtctgtgcagataatgaggcgtggcaatcacactgcgtattccctgtgcatatgcttctttcagcataaaccgggtttcccccagatatctggaaccgtcatctgctttggggataatatgggcatggacatcgattatcccgtttactggctgcaacatagatacactccctacattaatagtgtcaggtgaaataacataatattgatatgtttttatggacaacaacataatatagattatgttgagaaagaaaccacataatatagattatgtcgtgaggatttgggatttttttattgctgcgtgaatagaataatgaaatttttttatagagttttgaaatatgggattttcatagacaggagatgggattttttgtaaataatggagttatttgtatttttagatacttcatttgggggagcaaaataaaaaacaactggtgataatattgcattatcgataggttattggtataatatgggaattaagggtaatgttatgaaaagtgaaaaatattaaattaataattaatttagatttttttaattttctaatagacgttttagatttttaggtgtataatacgacataatctatattatgttgtaaataaaaagctttaccagcatttattctaattgctttcttatagcaggagtttcattcgatcaatttgccgcctgtgctcttcccccgatgatatgatataaatccttgttgtgttgatactgctgtgtcccagtaggtcggccagcttcgagatgtctttttccatcttgtaataggtctttgcgaaaagatggcggaggttatggggaaagactttgttttctctcacatgcgctatctcacataggtttttcatctcccgccatacattactgcggttaatcgggttgccctgcttggttatgaatatgggaccctggcggatgtgctgcttcttaatataggttaacagcatcatctttagcttatggggaatgaaaatttgccggctcttgcctttgcagtttacttcggccacgccgctttgcgccgctcggacggtaatacattccagttcgctgatccggattcctgtactgcagatggtctggattattaaggagaggcggtctttctgcaattcctgcgcggcttttatgaggcgatagtactcttcttttgaaagttccttttcctctgggcagtaaacccggcgttgttgtttgatttgcttgactttgcattcgtagagaccggcaaaatcgaaatagtgattcagtgaggccagcatggagttgatgctggcggtggcgtattgctgttttagttcctccttgtaggttataaccagttccttggtgatggggcgaccggcggtgtaggtgaggaatttttggaggtcgcggaggtatttggtgatggtggtgggggatttttcttcacctattaaataatgataataggtggttaatccgggaatagatatcgagttagtctctggaaacatcatttcagccctttcttataaattacgaagtataaataaatctacagttagttttgatataatcttctgtttattatacacataaatttctgtaagcacatattcattaaattggttaaagaggtggctctcgacaacggattggatggctctcgcgaggcagtatattcatccggaaataaatcggtttgatttgataatagtatttagaaatttgtcaacccaatttcaagttacaaaaaaacgacatttaaaggttcttttatatgttacagttggactaaacataagaaccaacatccatttgttgccatgcaacaaaaataaacactattaacctaaaaatataaaaggaataatccttataaaccataaatgagagcagtactccgaacgttattcctaaagctatgagcctatgaaactttttctgtaaaataacctaagtaaggtccttctatgatacaataaatatcattaggagggccttttactatggcaaaacaaaagaaaccagttcacagagttgaaatgactgaaggaaaaaggaacatcatccgccagcttctcgaagaatacgatatcgagaccgcagaagatatccaggatgcactcaaagatcttctgggcggcactattaaagaaatgatggaggctgaaatggatgaccatcttggatatgagaaatcccagcgttctgacaatgacgattatcgtaacggttataaacgcaagcaggtaaacagtcgatatggctctatggaaatcgagttcccacaggatcggaaatcgacctttgaaccacaggtggtgaaaaagcgtcagaaagatatttctgatattgatcagaagatcatctctatgtatgccaaaggaatgaccactcgccagatctcggaaacgattgaagatatctatggttttgaaacatcagaaagtttcatatccgatgtgacggataagatacttcctcagattgaagattggcagaaccgcccattggatgaggtatatccaatcctttacatcgatgcgatccactattccgtgcgggataatggagtcattcgtaagcttgcagcctatgttattcttggcattaatgcggaggggaaaaaggaagtcctgacgattacgattggtgacaatgaaagtgcgaaatactggctgtcagtcctgaacgaactgaaaaatcgcggagtaaaagatatcctgatcatctgtgccgatggccttacaggcattaaagaagcgatttcagctgcgtttcccaaaacagaataccagaggtgtattgtccatcaggtaagaaacaccctgaaatacgttccggacaaggacagaaaagcctttgctgcagatttaaaaaccatctatcaggccgctgatgagcagaaggctctggctgccttggaacgtgtaactgaaaaatggactccgaaatacccgaattccatgaaacgctggaaagacaactgggatgctgtttctccaatttttaaattttcaaccactgtccggaaggtcatttatacaaccaatgcgatcgaatcactgaactccacataccggaagctgaaccgtcagagaagcgtatttccaagcgataccgccctgttaaaggccttgtatctggctacttttgaggccacgaaaaaatggactaccaccatccgtgattgggctcaggtttatggagaactgagcattatgtacgagggacgcttacccgagtaagcaaaagaagggttaagaagacaggcgggaaaccgcctgctcttgacatgcccgtaagcaactgttatatataaaacaagaacgacaagcctgattcacaagcttatcgctcttaattatcatagaagaatcttatttacagagattttctcatactctcaaagctatcgtttccccagataccccacaaaattctgtttattctccaatggagtagtcgttggtcttccaagatctcccctcgcaccgattgcacactttacctcaatcagtcgcaattcgttcccattctttgccttcagaagttctatatcgagagtatcataatctgcaacacttactgcatatggataaccgcaggcttttgcaatagctgcaagatcaattttcgccgctgcagtaggcataccgccaaccgtttcatgcgcgccattgttaatgataatatgaaccatattctcaggatgattagctccgagaactgccagcgctcccatatgcatcaaaacagcgccgtcgccgtcaatacaccaaacttttgtattaggtttattgagtgcaatgccaagagcaatagacgaactatggcccatagacccaaccgtcaaaaaatcatatttgtggctttgtccatttgtttcacgaatctcaaataattcacggctcgcctttcctgttgttgaaacgatcgtgtcttctcctgtaatccggacaatatgttgaataatttgttcacgtatcatcgtatttttattttcatatttcaccgcagtttcataagacagcgcacctttacaaactacaaaagccacgctctgccccttatccagtcctattctgaattttttcattgcatcacgaagttcttcttccgtcgtatttttccctacaataaaagagtcgattcccatatcatccagcaattttagggtcacctcaccttgatagatatgttgcggttcatcatgaactccaggttctccgcgccacccaattacaaaaacaaccgggattgcatacactttctcgtttaaaagagaagcagcagggttaattatattaccttcaccggaattttgcatgtaaactaccggcactttgcctgtcgccatgtgatagccggcggcaagtccggtacagtttccctcattcgctgcaattatgtggtgttgcggatcaattccataggtatttacgagataatcgcaaagggcttttaattgagaatcaggcacaccagcataaaaatcagcgccaattatatttacaaatgattcaactttcatctgcgatactccattctagttgatgtttaaaattaatttgtacagataacgtaacgtttctttatccaatctcaccggattattccttaaccgtgccggattcaccgattctgtaagcacttcaagatcacttacatttttcataattggagcatccattcccagttctgccaaaatagactggtatctggtgagtgcttcttctattgagccgcagcccatagcacttgcagtttcaagaaacaaatcttcaagataatcttttccccgcggatcaatacatttttccatatgttgcgccatatagggccataatgccgcattgcacaatgctgctgcatgtccatgggcgattccataaaggcttgtaagcttatagcacatcgcatgcccggctgtcgtttgagtgatattgatcgccttgcctgctatattagcggcctttaacattgccgtgttgccaatcgcttcattggcaagataagcgtttttatatttcatcattaattggattgcttcacgcgaatactgtttactttcttctgttgaattcacggaccagaatgattccattgaatggcacaatgcatccagcattgtagattttttttggtacaatggcaatgttttcaagacagacgcatccatcaaaacacaggacggaatacagctttcgtccgcaatcgactgtttttcaccattataataaattaccgcatatcgtgtcgcctcactgcctgaaccggccgtcgttggcagtgcaatcagattaacatcattgggtgtgattttttgttcaatgtaattaacagaggcatccatgttggaaaaaagtttaatacattttgctacgtccattgcacttccgccgcctgccgccatgatggtatcgcaattattctgacgaaaaattttaaccccttctaccactgaatcatatgttggatttggtttgtaattactaaatttgacaatctttacccctatccgtttttcaattgtctcaaagcttttgctaatggcaagagaagaaaatgattccccacaaactaaaagcaacctttttacaccaatcttttttaaataataatccagttcagaaaatacgctgtctgtcactaatatttcctgtttcttcattgctttcctccatcagctctcttctggaatcaatgtaataatatctttaatcgacatacatatatcatcgcattcttttgccctatggttttccaaaattgtgcgcgccgcattctgcatggcagggaatcccgtccgcgtcaactgatttgcataaatgacaacattcacgccgcgcgctttaaattcttcttccgtaacagtattaaaagaggtcggaaccacaactatgggaacttccggttcctgtgcacggaatttttccacaaactcgaaaatttcgtcgggctcctttttacggctgtgaatcataataccatctgcccccgctttcacaaatgcaaatgcacgtgtaagggcatcgttcatcccgcgctccaaaatcagactttcgatacgcgccactatcataaaatcctgcgtctgttttgcctgtttaccagcggcaatttttgcgctgaaattttcgatagaatcttgcgtctgtttcacttcattaccaaacagagaatttttcttcatccctgtcttatcttccacgataatcatggaaactcccatgcgttccagcgtttttacagtatagacaaagtgttctgtaagtccgccggtatcgccgtcaaaaataatgggttttgtagttacttccataatgtcatcaattgttcgaaaacgtgaagtcatatccactagttcaatatccggttttccttttgcggttgagtcacacagcgagcttacccacatagcgtcaaactgatgggcttccccattctgataagcagttgttttctccacaattaagccagtcaaaccactatgcgcctccattgcagtaattgtgcctttcattgcaattgcttttttcagtcttcctcttcgcacatcaggcagtgagagttccgctctcgctctattttccagcgcctgatatttttcatctgcagaataaggaaactctaccaattttccgccataagaggccagaaccgacactacttcatcacgaattggtttttgaaaaccggtaacccaatcatctccgtgcacaacgtaagttggcttatacttttccagattttctttatagctcaaagttttctgttccactacctggtatacaccggaaatattctcgaacagcgcctgtcgttcctcgtaaggtaaaaggggaaatcgcttataactgatgacagcctcatcagacagtacgccgacaatcagtttacccaattttccagcttttttaataatagaaatatgtccgctgtgaatcatatcggtggaaaaacacatgtatacggtacgatttgctatctcttttacctgtttcgatacaacagccaaatcctccggactgtcaatctcactgcacaacttattttcaacatccagcgctttaatcaagcacctttccgacacctcattaaatgcattttccgcatagcattccacacgatcactctcacagaacgccacgatattagacagccatactttccagtcatgcttttcaattttatacagcggttgtgctgcaactgcttcattaaaaaattcaatgccaatcttggaaatgtacccgttatgtataaccgctttaaaatctttttcaggaagagggagtgtagaactaactgccatgcagctttcctcgtgattcactacagaatcaaggactgcactttcaaataccaaatcgccatgcatgagtaaaatatcatcatccaaatattctcttgcgcagtatatcgaatagatataattggtttctttatacagttcattctttacaaaagtataagtcaacggaagttccagactttggcaatagtttacaagtacactgtcaaacagacccgtagttataacaacctctgtgagaccggactcagctatcatttttagctgccggcttaaaatagtatctttattggaaatctccgtcatgcatttgggatgctcagatgtcagtacccccatacggctgcccataccagaatttaaaatcaataccttcataaaaccacactctttctattcaaaatttagtatgccgtcacaattctactgcgacagtttttcttgaatttgtttataaatgatctcgttgttctctgcactatcataacacatatattttctgcgcatctgcccgcgcaaatcctgatgcctgcacggatcttttaaattcttttctatatctgaaataagcatttcctcattgaccgctacatcacccgctgcaacctcttccttggaaaaatacagtcccctgtcattatcacggtaaaattgataatcatacaaataatattggacaggtcgatccaacaataggtagtcaaatgaagctccggaataatccgttatcaatatatctgccgccgcaagtaaagactgtgcgtcccaatcttttaatataaataccctccccagcacttctgttgctttagaatgccgctcctgatttacaaaatgtgccttttctacaattactgcattatatttctccaatatttttgtaagtctcctgttatcagccaaagacgagaaagagaaagtattttcccgcgtgtcccgaaatgtaggcatataggcaattatttttgtatcgctatccatgtttatttttcctgttaatccactcctcgatttaatgtgaaatcttttatcgtataatacagtatttcttggatgccctgctaaaatgaaattcctgtttttcgctccgaacgcactttgatagcagggacgaaacacatcagacggaatcacatagcagtcacagttaaaagcataatcatataaatagcaataaattaaaaaggcccatccccgcatattactgccactatgtccgattttcttccacggaattccatgccaaagatttactgttactgcatttccaaaaaaattatttccttttgaagaaagatccctaagcccttgtccaacaaccacaacacctgcttctgaaataatatgctttgcctctgcagtattcatttcacatactttgattttattgttaagcctggatgtatctactcccttatttgctatccaaataagtttaatttcaggatgaacttcggctagatagtttgcgaaatacatgcagttatcattgcattttcttccaaaccactcaccgaaaacccaaatgtttttattcgttctattccctctgctgttcattttaactgctatagcgcttaataggttccatattttctctgctttattagtttgactcatacctgtatgtccgcctttctgctcacgcttttccaatagctgaaagcacagaataataatactgccagcacccccaaacgaaattcaatatacgaaaccagagtgaccgcgatagctgcgactgtcacacataatccaccgctcaagaataaaccagaccacttaaagtaatgtacgttaccgattcttgacgatataaacgcatgaaatgcaaaattcaaaccataggtcactgctgtcgtgtacgctgctgcaacatacccatacatgggaataaaaatactattaagcactatatttatcattgcagctaccactgtacccaatgcaattaatttggtctttccataataatattgaacctgtacaggtattgtgtataaaaaagcaaaaaagcctcccacaagaataggtatcacacaatactctgctccggcatatgaagatgtgcctaagataacaattaattccggtgaaacaagcataattgatgatacaaacaaggctaccataactgcatactgtgttgcacgtttttctatacttccaatctcaccaatttgagctttttcaaaaaaccacggactccaaacattttccagcgaggctgttgtgactccaacaatagaatagatgttataagcaaagctgtatattccggcctgtgccgcgccgcaaatgctatttatcatgattcgatcaaactgatttaataatacctgcgatattccgtgcgggattagaggaacactgtaggccaaagcaaatctccaataacgaaaattagttgttctgtctgcaggcggccttttttctttccaaaaatacaaacaaataaacaccgctaaaaacaaaacaggaatcaccgttccgactatacgtccctttgcaggatgccagctaaataccgtctttatcagcagaatagataatccaatattaaacacggcattaaaacctgctgccagtaaatagcctttataactgtaagtaatacttaaatacacattaaaaatagaaagtatcgcactccccagacaatgtagtatcaataaattatgtatccagtagtcaaaccccgtatatgttgttaaaggtccttcaaacatctttatcagaagaagccaagtccccgcgctaactaataacaatatcatgcaggaagacacaaattcgccataatctttcccatatttatatcttgcatttttttgacatgtattaagtgtaaagcccacacacatacaaagaatactttcataagcaatatatgtattataaataccatagttatcaggggataaaagacgtgcaaatattggaattgaaaaaaacgtcaatcccttaatcatataatttccaatcgtataacctaacccagcttttaaaatagcattaccgttctgctttattttcttcatgtgacatactactcttttcaatttgttctatgtgtctgacaaattcttctggttttgagaacaatggcagtaacgtcagaagttctgactctggcaggtcccaccaccttgttgcggaaattctttgacacaattcttctttgaatctatatcttaatacccttgcagggttaccggcaacaactgcgtatggcggaatgtcttttgtaacaatacttccagctccaataataactccgtcaccaattgttttaacattgggaagtataattgcatcagcgccaatccacacatcattcccaattgtaagcattgtatattcgcgcatatctttctccacccagccacataccgggttaaaggcatacggggaggttgttatcatatctattgcatgattcactgggaatctgcgaactcccggcccaaaactgcaatatttgccaacctcaattggcccgacaattaatggagactcccatccatatggcatactctccgcccgtttattttcagcttcatacagtagctttctcagtgattttgaacgccatgcaccaccttcgaatttttcgcatagtataatagctatacgctttcctaaattcccacatttgtatatttttttggtcacaaaaaataacattaccttctctcccagctttttacttaacatttttcctgtaacttggccttctatgctataacgttttatctcaatttcatgtgtctgataaatttttttgcaaatctatatttttatattcttgcagatttcagcaacaattccgtaaggttattaatttaattttagcaattgacaaatatattaatataacagcaaattgtggctctactaatatagggcctccccaaataatagatacgatgataagaaacattagtacatatcgcatttgggatttatatttatgtagttgataaaataacaggcacatataccacgtacaaaacaaggcacaaaaaggtccccataacaggatcgaagccagtaatgttgagtgtggatatgtcggaaatccatattgaagcatccaatattgcaagtcataatagtcattactcaatcccatcatattctcttcaagtattttcatgcctgcttctatggatgcctgtcttcctaggatggagctatcgctattaactgaaccaataaagatttgtgtcaccgactcagaaagtcttttaattggctcaataaatcctatttgaataccaaaaccatcaagagcaacaattattaaaactacaaacacactaatataaagcatcaatacaagaaaatttattttatatttatctgacttcccaacttgtaactctaagcggtttttcattatttttttaaaattgttagagacaaaaggtaacaaacacattatcattataaaaatatttgtccgctgaccagacagtaataaccccacaaaagcagtaaaaaataaaaatgtaaaacgtctgtcaaacgttcttgtatatactaacaataaaatataactagccaaaaaaaaacctgttcccccaacacctaagcccaatgccccaagtctgccctctgttgtaaagcctaatactgcgcgaaacaattgtgatgcaacagcaaatatcacataataatctaagaatttttcaattttagcaacctgatttttgcataacacacatacagtaatacacaaagcaaaactttgagtcaaaattaaaaacatctcaaaataatttgaatcaaaaatactggaatatccacatatccatcgtattaattctcggcatagcaaatatacaatcacatatccaaaatgaatccccttatactttcgacgttttaaaaacgcaaataataatataggaatagtcagtattgaaaaactataagttaagtagttataccaatttgtatcaggtgtaacggttgtatatattgcggtagcttttgttattgatactacagacagaagtgacaataaacaataacctttcatgagtacattaattgataacgtattttgagatttcattattgttctattcagttctcccattgtatactgatttcctttccgcaaatttagatatttgttcaagataagctgtgccatattccttatctggttctaaaaatgctccttccgcccattcattccatgcattaataacaattacaggagaatgaagctcttgggcttttttcatcagcttacacatatactctccaaatttttccggtgtagctcccgttatgacagtagcattgtaactcttacgcggagaattatcccaatccacaaatgctcctaaaaatgctccttccatatcacgcctggaaagaatttgcttccatattatgtcgtatgatacacgcattctaactatccccttaccccttggcaaaaggaaatatgtgtttatcacctcaataactcgtgtctttataatccttattattttttggacgattttttcttgagaaaacgtatagttgggttctcttgtaacaattgcggaaaagttccccttgcttttattgtcgcgggaaccttgtgctttaataaaatagatttctggaaacccatcagcttttgccaattcattccaatatgaaatgaattcgtctacccgtgaaaaattccaagcattataaattgcatatattggtttttcatcaatacacatatatcgactatcatgaaaaaattttctacaatactcatactgtcttttccactctttttttcctccatactcttgcgcccataccacagtattatcttgtccaaaccacgactttttccaactttcatttgcccaaaacaagaagaatgggatatccaaatccctattatctcggatcatctccgttggaacatctaataacttttttccgcaggaatagtattgataaatagcaaatccatcaatcccatattttttcgccaaatcaatctgtttttttatattgtactttaatgaaaggtcgtaataccaatcattcaaagggactctaggttggcaatgtccacggaaaagcggctttgcagctttgcatgcaacccattctgtatagccttttccccaccattcatcattgtaagatgtttcataatattgaggtaaatataaagcaactattttagtaccactgatttccaaattaaacactcctataatgtccactaccgtttatagacttttttacgaatagcctgccctaaaatgccaaatagcgtcactttttccgccaatattccagcatatcatgtactgtctgttgcataggaatttcctgcatccatccagtatcccgcttaatcttagttatgtctccgacgattacccgttcatcagttggccgcagtaattgctgatcaacacaacgttctaatttatgtccaatctccctttcaatcattctcacaatatcatccatgcgatagatatattctgacgatatattatatacatctcccgcatgacctttctcagacaatagtaaaagtgcctgaataagatctctctgatccataatcgctctctttgtattcagatttccgacacgaagctgataattacccgtacgttcagcctctatcgcccgtcgtgtaaaatcacttgtaacatcattcacttttcttgtacctgtcgaattaaaaatacgggcacggatgcatctaatatgatcattcataaaatattgaaatgcaagtaaatcctgtccgactttactgacaccatatggatgcaacggcttcagttctgctgattccttaacaaatatctcttctccctgtaattcattcaatgtctctccatactccgcactggaacaggcaaccaccaccattggatcataagtagaatcatattctgttctgactttcttgactgcttcaaacacactgattgttccatttacattggtgtcaattgtagcatagggttgtgaccaggaaacaaccggataactctgcgcagccaggtgaaaaatcttttctggccggttttgtaaaattattttttcaatatttgcaggatatcgaatatcgcactcaagcattttaatatcactatgtatttctgttatatctatagttggtttataatatgtccctatgaccgcttcgcccttctcatataacacttcaaccatatgagaacctaccataccgcctgcacctgtaacaagtatcatccgattatccttctttcactattaatttatcatcttcaaatatcgctttggctgtattgcaaaaatttttataatagtagtttgatataaaagcctgcctcgcctctttactcgctgtatcaatattcttttcaagatatcgaaatgcagaataaagttcgctgttattcgttggagagcctattaggcatcctgattttctgttctctatcacatattttgatataccattttcattggcaattacaggtgttcccatcatcaaagaactgggcagcactccgctttgcgtgcttctcgtataagcattccatacacaaatactctgcagatagtaaccgttgatttcctcagttgtcatatacctgccatcatgtatatataaaatttctttttttaatgcttttttaatacaagggcgtttgcgaatatggctcacatcatcttttgttgctatcaaaaatttgactttcaaattattttcaatggcaaattcaataaaagatataaaatcttcagtgccatgcgccggtataaaaccacctataaaggaaaagtattctcgtcttatgttatttgtctcattatatttgtctttcatgataaggggaaaaaactgatagggagcgcggtatactatatgtgcacgcttataataattcactccggcctgagaaggcagcaatacgcagtaactgttacggcaaattacagcattaactatcgcagcagcacaaatacgcagtgccttcttcccctcctttactaatccggtcagccccatccatggatcatgtaatacataataaaacctgatatttctctttctgcatcgctttgctaaggatatattttcactgccaatgttatatgaaatgattatgtcaaatcccaaattaactacttcttctattcctttcccaataataatacgctctgatcctttataatgaatccgatatttcggtgccagcactaaataagtttcgtgccccattttttcaaacatagaacaaaatgcttccatatgttgaagctggtttggcgagtatcttattgatgcaagtgcaatccgcatttcctgcactctcccttcatctaatcaagctgtcttttaatctccaaaatgccttcaaactgcgtttgaaatccgaaacatcatggagtcccgcccaaattctgtgccaaatataccaaggtctcatataatatttctttctagcatgagcacaaaaatcaaccagctctttcgcacttaattctggagtatttaatatacaatttagtgtgccgtcttcctgcaaatattcatcatatttcccgttgatatatccattttcttttgcccattgataggcctctgttccagggtacggtatcagtggaaaaaactgtaccgtatccgtcttaaatctcatggcagcgtctaaagtatgttccatggtctcctgtgtttcaccctgatttccaaccatataacaagcatgaatcatcaaaccagccttttttgcattttctacatacgcatcaattagctttaaattgctgcctttttttatattctttaagatctgctcattatagctttcgaatcccggaatgataaggtggcatccagccttcttcatcgcctgcattgttttgagatcgatgtttacccgcgcattgcataaccacttaaggcgctttgtaagttttttctcctcaagcaattcgcatattttgattacacgttctttattggcagtaaaagtatcatcttcaattaccacctcatgaacctccgggaaattctttgcaatatattcaaattcttccacaacattttccggacttcggaggcgatacttatggccgtgcagcgtttgcggatatacgcaataattacagtgagccgggcagccgcgtcctgtaaagatttgaattgccggaaatgacgcggcaggaaatacataatttctaatatccaaatattttttgataaagggagccgccatcggaatatcatccaattgttctatgtaatctgcatctggcgtttctttaatttctccgatgacatcccgatatgtcaacccacgaacacggtcaattgccacattgttttccagcgcttgcgctgtctttaatacaatatagtcatattcacgacgcgccacaaaatctacagcatcattaatattaagtgtttctattggtagtgccgatggatgtgtgcctacaagcataatcttgcttcctggatatttctttttaaggtgttcagcaaatgcgacatcattgtaaatcgaaggtgtacttgtatctaagacaaagagtgccgcatctgctgcttccttatccactctttgcaatgtttgctgaacatctaactgcttggccggggcatcgataaaagcaatttcaaatccattattctcaactacagctgctgcataaataagccacaacggataatacagcactccgctatgccctatacatggactgcgtgattccctcgaaaattttccaaactccgctttaaatgggggatttataaaacaaaccttcatacctttgccacctcattatttaaagttatatatttttttaaaccattgagcatataccagatcatataatacatgcgtgaaactacgtccaagcctatgtatctatatgtattccaattcatttttgcagcaattaatttatttcctgattttgatttcctcataaagcggtaaatgagcaaaggctcatcaataccgtatgcttttctcccggtcttgagtatcctaagccatatagcaaaatcctcatgcatgttatcccccgacgcatagtattgcatatacaattcttttcgtaccagagcagaagaatttgagattaggttctgtttcaacaactgcctgtagccgatttccagtggtacatgcaaataccattctattgaatttccagacgaatccataaaagcagaacccgtataaaccagatctgcatttttttctttttgaagcctgatctgcttttccaatttatccgccgtccaggcatcatcactgtcaagaatagcaatccattctccccttgccttctcaagtccatatctgcgcgtataagaaacaccacgattatagggattattaatcaaaaatatccgtttatcaaatgcttcaaacttttttataatagaaagagttttgtcagtggaacagtcatttattataataagttcaaattgtgtatacgtttgtgcaattacagacataaccgccttttcaatagtattttctgcattataagcagccataattatacttattaatccaaaattttgctccataccatactctcctgtcacatatcatttgactagctaataccttttatacacctctcgccttgaacagtattttcactatccgtcgcagctgccatttccaaccttgccgctgtagcttgtccttccgccacaccttccgtactctccggtttgaacaatattttcacagtcgccaatacgatcttcatatcctctatcagactcggatgggcgatatacatcaaatccatctgcaacttgtcataggggatagtgttatattttccatacacctgtgcgtacccggtcaggcccgcctttgcctgcagtctcagttcgaattccgggagatgctcacaatactgcgccgctatctccggacgttccgggcgcgggccgacaatgcttaaggagccctccagaatattaaatagctgcggcagttcatcaatccggtacttacggataacacgtcccacgaacgtaatgcggtcatccttttcaccggtggaaagccgggccactccgtctttttccgcgtcaggctgcatgctcctgaatttcactatctcaaaaggccgggcgttttttgtcagccttacctgtttatataaaaccggtccgccgtcctctgctttaatagcaatcgccgttacaatcataacaggacttgcaatcaccagcgccgccagtgaaaaaaagatgtccatcgcccgttttaagaacagatattctggctgcgccatatagcgtttcacctgtagaaggggcagatgaaacatatgcataggatttgcgccgctcatgatcacatctccaatgcagggaactacataaaccgtgatgcccctggcaatgcaatattttaaaatcacattccgttcatggctatgtacaccgcttagaaacaccgtttccatatctgccagcatttcaatgtgaacaatgcattccgctgcactgaccgttttcttcacgtcatattttttattcataccgtattcatcaatcagtttcgtcatctggctgtgccggccgtagataaccgccgtagtgcaaggcggaaaggtccggaaataccagtgattggccagatatgcccacaccgccgccagcaatatttgcccgcagaaggccatcagtcccggcaaaatattgggcagatgcttgctgagcagccagattattatgtataaaatgccgtcgcacactgcaaacgccagactctggctgtatatgatctctgagattcgctgcatcgacatcagaaatccgtcatagacgcgccctatgataatatacagggcaaaatagatgaaaataatcagcagatctccttttgcatgataaggagacgcagttcgttctgaatagtaccagtaccagcaaatcgcaaacggtattgtgatcattactgcatccagtattttcacaatcctcagtgcaagatcatgcctaaaccttttcacagcactctcccccttgatttttttaagccaaagattttccttttcgaagtctagtaaagctttccctcgaccagatattgttccgcccaccctgaaacaccaaatccattcaatcaatataatccgtcatataaatcaactgttctcaacgctcacacttcttcatctctatcaacattttcaacctaatcccccattccccccggcttattctccagggggacaagggacactctccaaatacatctgactaaatcaaactaaatcttacttcttataaacaatcgtaaatggagttgttccgctcaggttcacggaaacttctttcgtagcataattaatgctgctaggcgccatcagctcccatgcctttgttgtctggttgtaatacagaatctgaacatcgttcagtccttctaccaggttcggcacgtagaggttcaggctgacgccgtctccggccagtgctgtctgaaccggtgctaacggaacgtatccaaccatgttgtttgttccgattgtacggtacagagcctcggttcctgcgttgattgtattgatcttatcaatcaaatcccaggataatcctgcctcacgaagagcattgttgtctgtggcaaatgtcacagaaccacttgcggcagcgcctccattgttgacaaccggcgctgcactctgctccagctttccagtcttcagagactcgctgcggctgctgctgttgtcatgagacggtctggaactaacacttccggctgcataagcagtcagaggctgtgccatcagtgctgctgcaatcagcaggcctacatatctctttttcatgtccttcactactcctttctaaataatatttatcaataaatagcggtctttcggctgctaattattgtcgccttagtctgccaaaagcactgcttcccgatataaagcagctactttacttccttgtaaaacagctcaaccaccattctcttcagagcttctttatcgggatgatattcgtcaaaacgttctgtctcaacggcctcaccgggcacagtcaggaagtctccctgccctatttgctgctggctgttcaaaactgccagccccatatccatatattggtctttggccatgttggtgaccatatgttcctcgatatccttaacaagacgggtaatcaatgttttatctgttctggcttcctcttttacctgtttcaagtatgcttccatatactgtttctggcgatccatacggccgatggctgtctgagctttagtaatatcccggtaacggacaaatatctccgcctgctttccattgagacggaccgtactgccttttgtcagagccggatctctgctgtccagcccctcgtcctgaatcgtaaccgtcacgccccccacttcatcattcagaagtgcaatggagctgatgtttgcagccagataaccatctatcttcaggtcaaacagcagattggaaaccgcctcctgcaaaagctcacagcttttttcttttccatcaccgtaagcaaaagccagcgtcagatgctgtgtatcctttcccagttcgttccccatcaagtcaaacagtgtaatctccgtcatcgtatccctgggtatcatcagaatccggaccgtatccctggccatatcctgggctgcaagaaacagtccgtccgcctgcccggccacaccggatgcctggtaggattccagttccccctgggtatccacgccaatacagaggattgcacggaccgcagtattcctgcggtataatttcccgtccagttctataagcccatcctgcgttttgcccgacgccaaattcagttcctgtccttccgaaagacctgcctccgcctgcttcttatcggtgtagaggccatagctaaatcttacaaaccagattacggcaaccaggaggcataaagcagcaacagccagaaacagtttgttatgtatcagcttatcctgatttctgttttgatttctctcgttaaccatggctgctctcctacactatttcttgacttcccaactgatatatcaaactaatctcactatcgacattacaaaaccttcgcttctttcccctgcttcgcattctcatggccgtaaccataatacttgccgtatttgccatagtaataataactgccctgcttgatatccactttattaagcacggttccaagtatccggcacccgcttttctccagctggttttttactttctgaagcagccggtagctgattgctccgctctcgataactagtatggccccgtcacagtggcgcgaaatcacggctccgtcgatcacactccccattggaggtgaatcaatcaatatgtagtcataacactccctggcccaggcaatcagtttagtgaatagttctccctcaagaagctctgccggatttggagaaaacggacctgaaaatataatattgagattcggaatattcgtccggtaaacaacctcttcttttttacactggccgctcagatactgagacagcccatccacctgatgctctagatgataccgggaaaccaataccgactttctgatatccgcgtcaatcaacagtaccttctttcccagctgggccatggaagccgccaactggaatgttgtctcactttttccctcgttaggagcagagctggtaaacataacggcatggatattgcttcctgaaaactggatgttggttctgagtgtcttcatggcttcctcatattgatagtcattgacttcaaatccctttaaaaccagttcacccatgcctctctcatcagggctaatcaaatcttcaattacgatttcatcatgcatcagttctctccccttccttttctgtcagcgccgctcttttgtctggtaccggcccctttctccggcgccttagcgccccggccggtgctgcgggattttttctgttttccctggcccttttttctgtcttcatttccgtctttcttaggaattactgcaagcaccggaagatccagatatttgcttacatcctcctcggatttaaccgtatcattcagaatcactcttacaacaataataccgcaaacaagcagcagaccaagaattccgccgattattgtattcttcagaacattggggcttgccttttcagacgcaacctctccgtcctcaatcagtttcggcggtaccatttccataatctcaccaatgtaatcggaggcggtattggcaacctcgtcaacaatggatttggccagatacggattcgggtcctttatcgtcagggtaagaattcgcgtgttattcggattatcaatcgtcagctttttctcaagttccctgtaagtcatatccagcttcatatggtcaacgactccctgaaggacgggtctgctgccgacaagaaccttataatcctgtgtcagctggcttccaatctgcaaatctgccagggaagtcaaggttgtctctttggaaagcacataaagctttgcctccgacttatactggggtgtaatcaggaatttactgtaggctcccgtaattgccgctccgatcagcagtccggcaataataaaccatatttttttcttcatctcaaagagaagctctctgaggtcaatctcaatttcatcatcatcctggtaaactttttccatactcttaaaatcctctttatccttattgtctttttgtgtttttatctgtcagaaacatgtaagattctgttgtctgtctatgttctttccagctttaaattaattattttctataagctatctcctgccagaattgcggaaggattttccatcgtcaatttctccgccagctcctcccctcctctttttttcagccattccagggactttgccagttccggcggccggtaatcgagacggtgcatatccgtacccagcaaatgaattctgccctccagaacctgttttctgcaccagttccgctcggataaacctttcagcctgcttagacacctgtaattcatctgcatatatgctcccgcatgaataagttcatctatggcttcgctcttcctcaaacattgatagcgctcgatatgagccagaactggaaagtatccggacagaatcagagaacgtactgccaaaaatatttcgttgtagggcactccaggcataaactcaaccagtacatatcttgtctctcccagagttaatatttcgcctgaagccagtttttccgtaacaccgtcgaaatacaggatctcctgcccctgataaagcttcatttccggtaaagacacagcggctttctcccgaagaagctgcatcttctctctcagcctgtctgcgtccgcccggttatgtccgcgcacataatgcggtgttgcgattactccgcggactccttgctcatatgccagtttcaataattctatcgtttctccgatatacctgcatccatcgtctaccccaggcagtatatgggcatgaacatcgataattcctttatccagtaacatttagcaatctccaactgtggtgtctaagcttgaatacaacataatagtgattatgttgtatttttgcttaattagagttggtatatgccgattgacttttaataatttgaaacttatatgtgtatttttatgaaaaccaaatatagaataaagattattaatttttttatatatagatggaaaaatttaccatatagaatggcagttcttcactagaatatcaaaaatgtaattttacaattattttctgtgattcttctaaagattatcggcctcgccaggatttagaaatagacaaaattatacaaaacaggataagtttatataagaaaacattgaattttccaatctttactgctataatagtcgaaggtcaaaattataaattttttattaatttttgttaatattatatttaatcgtacagatcaatttaatgtcggatttatacaacataatcactattatgttgtaccatcataataacaagttcatcttttcaatctgtttcctatgttcaactcccgaagagacaatataaatcctcgtcgtattaatattactgtgtcccagtaaatccgccagtttggcaatatccttttccatctgataaaaggaataggcaaacaggtgtctgaggttatggggaaatacctttttttcatttaccccggccaggcggcagatttttttcatttctttccagatgttgctccgatctaacggattcccctgtttggttataaaaatggggccgcattgaatgtgttctttccttatataatacattaatttcaccagaagctttcgcggcaaaaggacctgtcggtttttccctttgcagtccacctctgccacaccgttcttaacagcctgtactgtgatgcttggcagttcactgatacggatccccgtacttccgattgtctggataatcaaaccaatcttttctttcccttcccgtttggctgtccgaatcaattcgaaatactcctgttttgtcagctccttttcttccggacagtatacctgccgctgttttttcagctgcttgactctgaattcctgccaccccgcaaactgcataaatcggttcagggaggcaataatcgaatttacgctgttcaccgcgtaatgctcaaccagatattctttaaaacctatgaccagctcttttgtcacctcttcaccgtcaatatattcgacgaattttctgagatcgcgacggtatttttctatcgtattcttgcttttttcatcctgttccaaatattccccaaataatatttccatttcagcagttatcacataagtcgtcataattgttctcctttagtatgatttttcatctatattatcattaattggagtatattttaatagataacgcagtatttattatggtaattttttccatatattctttttccctaaaacacagcagacctcctgtgaggggatcacagaaggcctgccatgcaatattttattcaaatataacctgtaaccgtttaaaccagctccagtcgctcatctgcttcaattaacggcagcaaagcttctgaaacctcgatatattcgagccggagcgtactctcaatcctgacaatcttaagctgctctttattggctccccgcagcactttcacggcaattttcaccgcttcatcctcgtctctggctatcaccggaatcttgcagtcatctaaatccttgacggcaattccattggcatagattgactcataatccagctggtcaaatactttccttgtcgttatgtcgaatatcccaagtcccacgccgtttccgtgagtctcctccgagagatcgagaagtaccatcttatcaatctttggtaccggcaggataaattctttgagcagaaagcttttgcccaaaatattcggatcgtatccgcagccggaaatatcttttcctattttttcaactatcaggacatctatttccggtatcatcagcgtcggcatatttcccgccgctatcttcacaagctgcttctcgcgctctatcatggtttcagccggaacggcctctatccatgccgtctcatcataagcgttttccagtaccgcaacgccgaatccaatattggccgactgcataatcatggcagccgcttctttcagcacttccccaaaatggtcgaaactctcctcatgaatcgaggtgcatcccacatggtttccaagaccgatcaccagcatcttgcacagtccgctctggatatccgcaacaaaatcagtatggattttgacccggttgaccggaactaccaaatctgcttcgaatgccgctttgtcaaaatataccttcgtgccgctttttaactttccaatctccaccacatccaggcttgtgaccacgggaacacccatagcctcttccgtgatgccgtacccggtcaggatttccctttgtccctcctcggttcctccgccatggctccccatggcggaaacgataaacggctcgccgccgcatcgttttatctcaccgataatgctatgtacaatgaaagccagattcctgattccgcggcttcccacggcaactgccacacgctgcccttttcgtatttttccggaaatttcttcttttgcaaattccgaacggattctcccctccggatcttccactctgggtctgtcaaatttctgtctgacccggtgcatggacggcagacttatctgataatcctcttccagcatcaaaggcattttcctacctcctgtcttacacattttctaatatccatttatttcataagtcccaaaaggccaagtgtcaccggctcacagaatgtggtcaggccgagcgctattaggagtcctccgatgaaaaacagcatcggttttatcagccgcgtcatcggttcccccgagataccggcagccacaaacagattgataccgtatggaggtgtgacaaagccgatggcaaggttcatcgtaagcataacaccgaaggtaatcggagacattcctatctgagttaccaccggcagcagaatcggcgaaagaattatcgtagccgggatattatcgataagacatccgataaacagcaggaaaacgttgattaacagaagcaggacaatcctgttatccgtaacgctcagcatggcggctgcaattttgtgcggaatccgttccattgtcagataggctgcaaaggccattgataatcctaccataaatgtcgtcatgccattgacgctgatacttctgtaaaatgaatcgtatactcccttcaaatcgatttcccggtaaataaacacgctgacaacaaagcagtatacaacggccacaactgctgactccgtcggcgtaaaaataccggaatagattccgcccagaatgattaccggtgtcaaaagcgcccagaaagctcccttaaaagacacccaaaccttcttaaatgtcggcctttcacctttgcttacattttctccgccggtgcggaatacggacacaataatcaaaaccacacccatcagtatgcccggtacaataccagccatgaacaaatcactgatggactctcccacaacaacggcgtagataacaaagggaatactgggaggaataataacgccgatggttccggccgaagcggccagggccgcgctgaacggccggctgtaaccgcgcttctccatttccggaatcatgaaacctccgattgcggatgttgtcgccatcgcggaaccggaaatggcggcaaaaaacatacatgctatcgttgtaacaatacacagccctccctgtatccagcctaagagcgtatcggcaaaatctacaatcctctttgcaattccgccgctgctcatcagatttccggccagcataaaaaacgggattgccatcagaggaaaggagtcacagccggtaatggcgttctgcgtgataagcgccaccggaatattggaaaaacaactaagcgtaataaatgttgcaataccaattgcatatccgacaggcaccgacaatgccatcatcaggataaaagaaccaaataatacagctatattcaagcttccccgcctccttccacaggctctgcggcgccgtttctatactcttttaccgtccgccataattctccgataatacgaagagacactgcaagctggctgacaggaagactaaggtatacaaggtacatcggcattctcatagccgctgaaataagaccgcgcgtataaatcgatgccaccagttcaaaaccgtattttacaagaaggagacagaaggccagccagatgacgtcggcggctatgcggagcatagtctttctcctgctttcttccgaaccgcccagagcctcgatcctgacatgggaattatctctttgggcaacacttgttccaagccaaatctgccagataaatatgtatcttgccagttcttccgaccaggacagtgaggaactgaacacatatctcagaataacctggaaaaagacgaggattacggtaaaaatcagactgcaaaccagaagatgcgcctccagctgattgtagaagtttatgagtttcttcataatgcgcttcctttcacaaataaaacggagacactactgcgctctgtatttctcaaccgcgtctacgatgtcctggccatatgtggtttcccagttctcatacattggagccaccttatccgcaaatgccttgcgctcctctgccgtaagctcggtcagctccattccttcctcctgcagctttttaagatattcgtcgttattatctaattccatggaacgctgttcgtcgatgagctttgtctgtactgcatcgtccagaatctttctggcctgctcatccatgccctcatagaaatttctgttgatgacaataccgcagaaatcataaatatgttccgttgtgctgatatatttctgtacttcctggaattttgcttcgtaaatcagggatgccgggttttcctccccgtctaccgttccctgctgaagcgctgtaaatagttcgctccagctcataggagttgcatttgccccaagggcttcaaacatctttatgtatacctgattgctcatgcagcgcattttcagtcccttcagatcgtcgggagtcttaatcgggcgtttgttgttggtcatattcctgataccgttaaagttatatccaagatttaaaagccccacattgccgtcttccagctttttattcaggattgttccaaggtccccgtccatggcggcaaaggcgtgttccggggtgtcaaagaggtaaggcattcccagcacctggaaaccgtctacgtaagcgctcagcaggtttgccgacggtacgaccatggtcaatgttcccagcgctacggattccagcatggcttcatccccacccagctcgctgttcggatggatttcaaccgtaatcttcctgcccgatttcgattcgacctcctccttaaatgcgaggcagcatttatgcagggaatggctctccgaacagatatggccgaggctgatctggtaagattctcccgtatattccgaacctcctgatgccgggttctgtgatgtatcgcttttcgattcggactgggcggccggtgtgcctgaagcgctgcctgaagaaccacatgccgtcagacctgtaaccatactgactgccgttaaaatcgctgctgccgctttaacactacgtttcatattttatcctccttctggaatttcactctgtattattcgtatccgtttgtcagttaagctcagctcttgacggtaatcactccgtttgtcgcatccatatgtacgaaatccccgtccttaatttcactgaagaattccggttccactttatgcaccatcggaatctccattgctaccgccgccgtcaccagcaccgtgtcggctgtctccacgattaatccggccgggtgcttccccttcatcagcagcttgtaaagaccatccgcctgcaccaccgaacttccttttcccgacggcatgatgagtatctttcccgccacattctttccatttatatcgtgattgcgttcaatcagctcccctgtctcaggtactacgagataaaagcagaccgcatctttggaaaccagagcctcggcctcggccgtcccttttgcaatttttgcgcagtgatatgtacgttccattatttaaccacctttcctgaaattgccgcctctaccgcttcttcgagcggacggattaagaatttaattccgcggatttcattgtaataagcacatttcggagaatccgtcactcccaccgacccgtaatacggtttccagcacggaggtacatcgatgcaggtatcggctattatatggccgccggccctctggatgatgctcagatatcccattctgtccgccagctctctcgtaagggaacttgtcagcagccatgtgtctaccttgaatttccttccctcacagactttagcaattattccaacctggcggattgtgatgtgggggcacccgaacatcgcaaaatcaatcgttcccggctcattgcaaagccgctctctcgtatcctgcaaatctttatccgtaatcacgatttcccgtttaatctttttgcttccgacggccgcctccacggtaggggcctccggtgtgattcccgctatgtgatacatggatacgcatcccgatgtattgagctgagcgccgaaattcatgaagccctccggcgtcggcctttctttaatccctttaaaaacaggaacctcaagtcctttatatttttccggataacaccagccgagaatctggtagtcaaaatccgttttaacatccgcctggacgtcaaccaggatttccgccttgcggttctcgtcgaatagaagcccgtactccggaaccatccctgttatcgccgcacagagggcgctgttcgccccttcccggttggttcttgcgccaatcacggaattgacatatggggtcgcactggattccgagaaagcaatcacctctccataagccggaacattctgctgaagataaggcgtacagtcaaaggtaagctgcgctcccagcttccggtatgcctcattcgtggcaaacacgatattctttccctcatccggaacttcatgtagatgctcattcagatatttgatgcagatgctcggattgattgtcggggaaatcttgcacttcgccccttttgatagcagtttttcggcaaaccacaggtctgcgtcctgtgcgctgagcgccacatgggttctggtcaccgggaccatcctcggtgcatcgaaggtctctccgattgccacctgaatctccatcgccatggctgcaccctccccatacttaccgttcagcacatcctgttcataatttgtgagtttcatttccttcctcctttttcaattggactattccaatgcattaaattttcaataatttcacggccgtttttaacactctctttacttatggctcttattttaatattctatatataatttgtcaagctattttcagttttttgtttaaaattctatatttttaactttagtttggactataccattccagatatgtccatcttattatatatttaatattaaaattggaactgtacctatcggatgatttctcatatttacgcaagtcaagaccaccggcttagccggtggcttgcaccacccctataaggggttattacctgcttgcgcccggaaggcgcactgaaggtctgccaactgcaccacattcacagctgcccttaaaagggcgtttccagtgcttccttattccggcccagccccaaaaggggcttgctggtttgctttgttcacctactacctctccaagaggtttacttcttgtttttctttaccggctcacccgtaaacgggtcgatatactctactaacgtcatctggtcgtattccaaatcctcttttatttgattctggatatagctcttgattgccgctgtattctttcccactgtgtctacgtaatatccacgacaccagaaatgacggttcccgtacttgtactttaaattcgcatatttctcgaatatcatgagcgaacttttcccctttaaatatcccattatttctgacactgagtatttcggtggaattcgtatcagcatatgtacatggtctggcatgcactgtgcctctattatttcgattccttttctcctgcacaatgttcccagtatctgccctacatcggctttgacatctttgtatattacctgacgacgatatttgggggcaaagacgacatgatacttgcattcccatctcgtatgcgctaaactattcttgtccattttggacctcctgtgctttttatttgtggtttgcagacctacatttattctagcacaggagatgctttaatctaaagaactgccctccccctgcatagcagggggtttatttttaatgtgacacaaaaaaagaggcgcctgtttctccgaaaacagacgtctcttttaatactatattcatcactaaatcagattctgtccactctatttcctgtggtttcccttacaatatatccttctctttttccgctattttctcacagatgcttgtctggagatgaaggagggaacccgaatcaaaaacatagtcaaaatacaggactcttcctccagccttcttgtatttctgaatcaggctgaccataaacggctcgcccagtgtgctgtattccttcgttgtcagcaggaggtccgcattgcttaagctttcgccaatctcatcccgttccttatccgaaacaaaggttttcacaatattgatattctctaaatcccgaatctgccaaagcagattctccataaaacggttgctgatcgtccaggctaccactcttgtttccggtgatattttagccagtcctatcaaagtttcgctgctcgtgactgtggtaaccacctccaccttgctgaccagttccgggaatgcctggacaaacgtttcatagtggtgtgtcgtcgtcacaattatatcaaaattatcctccaaaagctgcggttccttcagcactgtttcgagtagaaaatattggatactgctgttctccacattcttatattcgttttttgccagctgaatcgactccggactgcactctacccaggctatcatcagttttacgtctccggccatatggcggaccatctgctttctgaatatgtccaccacttcgcgggtctggaggcccatctgctcggcgcggtcaaaaatattattaatctccttcgtcagaatctcttctttctggctgtttcctatctcagaaatgtatgtcccgctcccgcggacagcataagcatagccctgatgcactaattcctgataggccatctgaaccgtgcctcttgctatatggttttcttttccaagttcccgctccggcggaagcttctctccagccttcagctctccgctccgaatcatcgcatagagctgctccgtaatctgctggtacttcggcagcggcgatttttcatccagataaatttccatattcctcttactctcccatgtcaggatattattatgcaatgtccggcctgccatcgcgatttaactaaccacagcgccggaacttctccgcctgcggcgggtcgctgtagcggcattattccctgccgccgcaggcatcggctcacttagcgagtgcgctcctccgcggagcgttttttatttaataggtgaaatttcctgttaaatatataagaaatgccggaaatcttatccggcggcaaaagaacgattcgcgcacattttaccatcgtaataaagattcccagcgctatttcagctgctcgaagcaataggatttaaagcacttctgtacccgagccccagcattgataactttataacaccatacttggtataagtataccacattcagttaaaacttgccagcttttattatcgaccggcattgcatttatcaattttatgaaagtcatatttaatattttcattacataaaattagataaatataattaacaggcataccggtatatgaaactacgcagtaaaagcgctcttattatatcaatacttatccccttagcagttggttcactatctgcattattcagcggcaatatgtcatcatactctatgttcgaaaaaccggctttcagcccgccagggtttatttttccaatcgtatggacagtgctttacatactgatgggaatttcctcttatctcgtttatacctcaaacagcccctataaaccgaacgctttattgctctatggcatacagttattctttaactttttttggagcattatctttttcggattagacctttatctgtttgcatttatctggctcatcgcattgatctttataataatcagtatgataaaacaattttatattgtaagtcccacggccgcttatttgcagattccctatctgatatggtgtatatttgccgcatacttaaatttctatatattcttattaaattaagatgtgtgtttgaaaaggcaaaaaaataaaaacattatcttcaagcactgtaaattcagtatctctaaataatgtttttatatgactcggagtaacaggatttgaacctgcgacctctcggcccccagccgagcgcgctaccaagctacgccatactccgtactctgctctattattataccaaatatatctaaaaaatcaatgaaaattttctataattataaaaataaaggaaactcatgaatccgtgcgggttttatggtataatggccgcatagcgggcattatactgcgcataaacggtttctgcgtccactgcaggaatccggcgctgatttccgtcggctccacgttcctgagggattcgggtataatctcctatgaaaacataattccagaaaggcggatacaccatgatcagttttgaccttgacatgactctcctggaccacaacacagggaagattacaccaagtgcgctggaagcgattgatatacttcgaaaaaaacataaaatcgtacttgccacaggccgcgatatggacaactactacagccggcaataccgtgacattataaaacctgatgctgttatccatatgaacggcacgaaaataaccgtcggtgacaacctgatatttgaacatctgtttaaccgtaaattgttggaagaactgctttgcttctgtgaccgcgagggctatggaattgggatgactctgggtgatgacgattattacattcatcctgagattattgaggccagcgacattaacgcctggggaagctgcggaaggcgttttcaggatccatggaagatgcttgatatgaacatccggaccctcgcctttatcggcgatgaatcccaggtacgccgggttgaagcagaatttcccaatttaaaaatgcctttgttcgccggacgccgcggagccgatatcatggaacacggtatatcaaaagcagagggcctgagccgccttgccgcatatttcggcgagaaggaagacctctccgattccgttgccttcggtgacagtatgaatgatatggaagtgattatcaaagcaggcatcggcgttgccatgggcaatgctgtgaaagagctgaaagaggccgcggattatgtgacttctcccattgcagaggacggcatctaccgcgcctgcctgcatctcggtcttctgaccgactgaaccgaaaggcagttcacgttctacactgcctgccactccgcctgctcttcaggctccacatgagataacaacctcactcgctcggccggggtcatctgatccagcatcccggccagttcgtccggggtcagattgcgctcttcaagaatatctgcaatatgtttcaagtcttcctctctccgctctttcagaagctctttttctctcgccttcaaatctttaatttgtgcttccagagcgtcaatcatctccctgacctcactcagtttctccgtacatgattttttctttcctcttggcatagttatttcgtctcctttctcttaccagtttttcccggatcattaaattatatgcagtgttttgtacaattagaacaattatatggactttgcaaaaattcttctccggataaatgatttataaaaaggaggagccgggtggcccagtggccatccggcttattatgaaaaaaatattactattctgaatgtctgattaatttgtgttttttcttctttcgttttacttgattcatttgctttatctttatggtcttagtatatcttttaattgtgacctctgtttgtagaaaatgtgaatatattttgaacacacggtaaatattttgtgaaaggaaaattggcagtgatagcctgcacgctctgcatacaggccaccgccatcaattagttattgcagccgcagcctccatcattaatcggcattgcgccgccgcatccactgttgcagccgcatccgctgttgcagccacagccgttgttggaagctgcattaaatccgtctctgtagccgacagcgtaaccatcgttaaatcctgctctgtaagctctgttgcagccacagccgttgttggaaccgcagccactgttggagccgcagccactgttggaaccgcagccacagccgcatccgttattgttacatccgcatccagaattccagcatccacatccacatctacatctattaaataaacaacacatacttaatatctcctttatttgtttttctttatagtatatagtatgtacatggggacaatgtgttaccggaaaacctctatgcgcacctgacaggatgtacttttccgtgaaaagaaaaagcaccggaaatttccggtgccggtactgcgtctgcccaggcagaacccgtccatattacctcttcttttttccgccgggggtcctgcccggaaccctgaatttaggacttttaaaaacccaccagtgtgcgatcatcgtggcaaaaataaccgccagcatcacaaaatcaccggtcattcctcccagatggaaggagattgaatagctggccaaagtgtcgatggcaaacagccacttttcaacagagtatacctttttgatgtcataatcagccggattaatcgtgtccgatacaaaaatcagaaaatccctgttgcaaaacagatcaattgtctcggcaagaaacaggcaacctatcagaaaaaacaaaatatccatcaggccaatcctttctaaatcatattttgacggtctgtaaacttaaaattactattcacagccccgctgaaaaagcagttccgtgagcagtaaaacttaaacactgtgaggtgaaaatcatgtttaacaatgaaaaaatcaatcaggaaccaaacggcggcttttcatgtgccgctgcctgcaaaaatgcatccgccgcccgtaatctccgttcccggtatatcggcccagtccgccaaatcagtatgttcgccgacctgtactgcagcgggaaccttttgattctggaatcccatgacagagagacacttctccggatcatggacgtattaaaccactcaatcgaaccgctcgattaaaactttttccatgtttcccttgaaaacaggattaacaccgggaaaatctcaagtcttcccgccagcatgtcaaatatcaggacaagctttgccggttctgaaaaaatgccgaaatttttggacggtccgaccagttcaagtccaggcccaatgttattaaatgtggccgccactgccgtaaaattcgttatcaggtcttctccgtcaaacgccaggagaaataccgacagtgaaaacagtaacgtgtatgccaccataaacacattgattgaccgcactacttcatgctccaccacttttccgtccatcttaattttacggataacctgtgggtgcagaaactggatcagctcttttctgacggtctttacaagcaccaccagacgcgacaccttgactccgccgccggtactgccggcacaggcgccgataaacattaacaataccaggatcgtctttgaggcctgcggccaaaggtcaaaatcctgggtggcaaagcctgttgtggttataatggaagcgacctgaaacgaagcgtgatgcagcgcatctcccaggctcctgtacagacctgctgtatttaccgtgataattcctatggagacagctataattatcagataccaccgcaattcctctgtcctgaatgcctgtcccaccctcttcatcagaatcaaaaagtaaacattgaaattcacgccgaataatatcataaataccgtcacaacgttctgaatatagggggaataaccggcaatactgttgtttttaattgcaaagccgcccgttcctgccgttccaaatgtaacggtaacagcatcaaatagcggcatcttccccgccagcagaaaaaggatttccacaaccgtcatgaatatataaatcgaatacagcagcttggcagtcagtcttaccttcggtacaagcctgcttacggaaggcccggggctctctgctttcatcaggttcatatgagaaccgccggtgagcggaagaaggctcaggataaagacgagaactcccatacctccaatccagtgcgtaaagctccgccagaaaagaatagacttcggaagcacttcaacatcgctcaggatactggctccggttgtcgtaaaaccggataccgtctcaaacagggcgtccacagggcttgtaatagagccgctgaacaaaaacggcagcgctcccataatactcataaccacccagcacagggaaactgttacaaatccctccgaagtataaaatatctgttttttaggtttcttaatcaccaacgggacgccaatgagcagacataaggccatcgtgataacaaaactccatcctgcctgctccccgtaaatcagggcaacaatacagggaggcaccataaaagcagcctcaaaattcaaaatccaccccataatataaaatatgatggaataattcatctcttcagctccttctactttttcaaaatatcgcggatatcctgcagtcccttttgtgtagtcacgacaattaccgtatcgcccttcaggatactgtcctgtcctctcggtatatggattttcccattccggttaattccgccgatcagcaggttctttttcagcttcagttccatcagtgaaacgccggtcacctccgactcctcctgaatcgaaaattcgagggcctccgccttgccgtccagtatatggtataatgtctcgacattacttccgattgagttctgcattgcccttacatactggagaatgtaatcggccgttatatatttgggataaatcacgctaccaaggtccagtgtcccgatcagctcatcaaatgcaatccggtttacctttgtgacaagcttggctttggaattctcctttgcaaataaggcaagaaatacattctcctcatccatattggtcagtgttacaaaagattccgcgtccgtcagcccctcctccatcagaagccgcctgtccgtaccgtcaccgttgattatcagggtgtcctgaagcagttcgcagagcaattcacagcgtttcttatccttttcaacaatttttactttaatacgcatcgcagaaagctgctgggcaagataataggcaatggttcctccgcccactaccagcgtattcttaacctgattcgtctggattcctatcttgcggaaaaactccatagaattcctgggagatgcaataatcgataccatatcgccgtcgtgaagcacaaaattaccggcgggaatcgtcacatcgtccccccgttccaccgctccgatcagtacgtcacagcgaagctggctgtccacgtccataaccgtcaaaccgtccatatgaaattccggtttaattttaaattttaaaagctccaccttacccttggcaaacgggtcaatcttaatcgcggaagggaagcgcagaattctggaaatctcggtagctgccgcaagctccggattgataatcatggagattcccagctgttccttgatgaatcctatctcattactgtatacagggttccttaccctggcaatcgtgtggcatttgcccgccttcttggcgatcaggcagcaaaacaggtttaattcatcggaacctgtcactgctatcagaatgtcggcagtctgaaccccggcttccaattgggtgctgatgctggcgccgtttccaaccagtttaatagcgtcaatatcttccgaaaaactttgcagcctctccgccgacgtatcaaccatcacaacattgtggtcttccctgaccagttggtctgccagtgtgactccaacttttccacacccgataatgataacttccataaagtcctccgtgcgtacacttaatacaagtctgtacatttttgtctagaatgtctattttcctattataccaccatatcctgttttttcaaatagaaagaatagagaaaacggccatctcccccttgatattgcagaaatgaccgtctttctatcatattattaacttttttcactctttacggtatctttataccgtcttaatgccatcttaattctgtctttatatcatcttaattctgtcttaacgccatctttatcttgtcttaacgttttctttagcgttacatcagagaagacagtaccgatgccttggaaacgataccgacaagacttccatcctcctcgagaacggctatcggatattttgcctctgccgctataggcaggatatcactgataacggtatctctcgtcgtggtctcgacatccgtcacatagacttccttcagcgatttttcttcttttctcgccctgatcgctgattcaacatttacaatgccgaggaacttcatgtggcggcccaccacataggccgtggacactccgttgttcttcatctcgcggagcgcatactcgggagaatccgtctcacgcaccacgcagggagtaatcattacattctttgcgcagagaaccttcgtcatatctgcactgttgataaattggcggacatagtcgtctgccggatttgcgctcatctcctcaggcgtgcccacctggatcaggcggccgtcacgcataatcgccacagtatctcccagtttaaacgcctcattgatatcatgtgtgataaataccaccgtcttttccagcttcctctgcagggacaaaagttcaaactgcatatcctttctgacgagagggtctaatgccgagaacggttcatccattaaaagcacctccggatcgttggccaatgccctggcaattccaactctctgtctcatgccgccggacagattgcctattaatgtatgctcgtggcctttcaggccgaccatctctatcatctccatcgccttgcgttcccgttccacccttggaacgcctttaacttccaggccatagaccacgttaccgaggacgtccctgtggctcatcaggccgaagctctggaaaaccatggaaatcttgtcccggcggtattcattcaagtctttcttactgaaagtgtcgatttcgctgtcctcatacatgacctggccgctcgtcggtttgttaagcatattcagcattctgaccaccgtggatttgccggagccggaaaggccgatgatgacaaacacctcgcctctcttaaccttaaagcttacgtcccagagcgcaacggtgacacccgtttctttaaaaacttcatccttggtttttccctctttcatcagctttgcggcttctgctttgttggaggccccgtacagctttgtcagatgattcacctgtaaaatataatcattctctttttccctgtcttttccgtcgataatcactttattttctgccatccgcattgtcctcctttctcttgaaccatccctgagtcagtcgatccatgagaattgccactattacgactgccgtaccggccagaagtcccctgccgatctcaatacggttaacgctgataagcacttccattcccagtccggaggcgccaatcatggaacaggtaactaccatggccatcgccatcataagcgtctggttgacgccggtcaggattgtcggcagggcctgtggtatctgaactttgaaaagacactgccacttcgtggagccaaaggatctggcagcttccaccacttccggatccacctgcctgataccatggctggtcagcctgattacaggcacaatggcataaatagtcgtggcaataacggccggagctttacccagtccgaagaaaagcactgccggaatcaggtaaacaaacacaggcattgtctgcatcgtatccagaatcggccgcacgatcacattcgccctgtcgctgcctgaaatcataattcccacaggaaggcctataagaagtgaaatcacaacagacgcaagcacaatcgacagcgtttcatacatcaaatcccacagcccgatggctcccacaaggaacagaaggatactgtaaataatgccatttctcactttaccgctcagtttataacctccgaagaaaacaattgcaatcagaagccaccacggaatcaaattgaggattgcattgagaacattgatcagaatattaagcccgtccctgattgccttaaatacggttgactggttcgcaaacgctttcacggaagtatcaaaggcattgacatcaatcggaatcacaaacgggaaatcaaagaaataatttgtcttctcctgtgaaaggccgagcgcgccccttacatcttccgctttgtcttccggcagccactgatcgattaattcactatgctctgtcaaaaaccattttgcggtatcggtataggtaactccctcgttgtcctgcatataggcaagcgcttccgaggtcagcgcactgctggtctcatatttttccaggaattcgcagaactccggctcttcctcatagaactggttgctgacgccgaccgtaacatcgacagacggacaagcggtctctccggctttgtatttctccaaatccacataggggtaatcttccaggagcaccatatcatacttcccggtcagccaggttggttcccaataataaccgacaatcggctcacccttttcaaaggcggaggtaaatgccgccgaaagcgccgcatccgaccccggctggaagtaattatactgactgtcaagtccgttaaacttcacctttttctgcatgatctcattgatttcccagcccgggattgctccgtagatgcgtcccatacccggtttttcatcatccggaaaaacatctgcatacttttttaaatcctgcacggttttgagtcccggagccatcggctcaattccccgctccggatctccctctatcacgtatctcggaacgtaaaatccctggatgttgtcaccaaagttcgttcccagatccttaaagagtccggcatccctgtcctcataataggtcgacaggttgtccgtccactcctccatattcacatcaatttcaccgtttttcaaggcctcatgcataatcgggcttgaacccggcatctccttccaggtataaccaaaagcagattccgctaccaggcctgcaactgcattatggaatttcacactgtcccatcctacatcggcaaacgcaatctctcttgattttgtactgcatccggccagccctgcccctaaggtcaacaccattgccagaacagcaactattgttctttttttcttcatgtaacccctcctgtctgtcaattttttgtaatactatcccgtttctgactctttatcagtataacagctattcaccgaatacgcaatgcttagctagctaacaaagaattattaacatttccttaagacaatttttaataaattgtcaggattattaaaaatttaaactttcgttaatcgcttgaaattttcaaagaacagcggctgggtattccctgctgataataagatgcagaaaccgtaaacctggcgtccgggatataaaagaaaaaaccttggctatgcaaggtttttcagaagcagataacgggagtcgaacccgcctttccagcttgggaagctagcgttctaccgatgaaccatatctgcaaagtaaaggctcatgtattgactgtatccaatgatttatgctgtgaacaataaccattatatcacaatttcccaaaaagtcaacgaatgagattgacatatattatttaatcgtgtaatatagttaagcaaatttaattaaatcgatataactaaaggagtataatatgacgatcactgataaaatgaacagcttctattatcatatgtccctatatgagcttcagatgatgaacggaagcgattatttcaacggcctgtcctataacagccttctctatattaatgttattgaacagcttgaggactgcaccgtaagtaaactggcccaagcgctccatataaccaaatccgccgttaccatcaaaatcaatgaactggtcaggcaaaagcttgttctgaaggaacaaagttccatggataagcgggtttactatctgaggctgagcccggaaatagccaatataatggggctctatgatgagatattccagaaagtggagtcagatctcagaacaaaatatacagaggaacagcttgaactgtttggggacatcctgcagacgatttcaggctataattggaggcaattaaaaaatgaataacgaactgaaccgtgaaattaatctgaaatcaatcctggcatttaccctgccctctatttttatgatggtggtaatgtcactgtatactatcgtggacggaatcttcgtatcccgtcttattaacaccaacgcattttccgcagtcaatatcatttatccgctgatgagcattgtcatcggtctgggcactatgttcggaaccggcacaaccgccatcgtatcgagaaaactcggagaaggaagacaaaaagaggcaaaccagatcgttacattcattattctgtttacgattggtctgggcatagcattttccgtcgtctcctgcctgtttcttggtgatattattcatcttctgggcgccaatgacgccgtttttgactattgccgcgaatatgcgctgccgattattctgtttctgcccttcagccttctgcaggtgcagttccagagcctttttgtcgccaacggaaaaccgggtacagggcttttggtgaccctggtcagcggtcttgccaatgtttttctggactattactttattgcagtctgcaatatgggtgtagccggcgccgccgttgcaacagggatcggctactttattgccgcagtcttcggactgtactatttcgcacgccacagggaggctccgctgcactttgtaaaaccacgcgcttccatgcagactcttatgcgcgccatgaccaacggctcgtctgaaatggtcagcaacctgtctaccagtgttacgacctttttatttaacattatcatgatgaggctcatcgggcctgacggagtggctgcaatttcgatccttttatatctcgattttgtgctgatcgccattaaccttggatattccatcggtgtggctccgctattcagttataactacggaagcggtgattgccggaagctgaaaaagctgtttcgcataagcttatatttctgtaccagtgtcggcgtagtcatgacggcgggcaccgttctctttgcagactggctggcttccgtattctcaccggccggcagcgccgtacacgcacttgcggctaccggactcagaatatttgccgtcagctacctgttcaaaggcttcagtatttttacatcggctctgttcacggcattcggcaacggaaccctgtcggccatcctgtcctttatgcgaactcttatactgctggtatcggcgatcctgctcttctcctccctctttgggattacgggcgtctggtcggccactccggctgcggaaaccattgcatttctgctggccgctttcctggcatggaaatacggaaaggtttacaggtatctgtaaatcgtttatactggtactgcctgcggctttgccggcggcaaagcattctggtgatatgtcaagaactttttgaagaagattttgatatgtttttcagaaaaaagggtaactttaacagaccttcggtatattttacgtataaccgaatgtcagttcgactcaatattatattcggtgtccagcttttcgccggtgtacagttggtttttgaccagcaatccaaaaacgagtcgtactaatttacgagatgtaagcgcgagtgctcttttgtgctgatgtttggttacctcagcatattttctggcatagaaatcagcatattcagggatgtgcttcctgacgctgtttgccgcttcgccaagatagcagcgaagatagggatttccggctttcgacattttgttgtcctcagaagtgaaatctccggaatcacccttaggccagtaaaggccggcatatttggcaagggcatcggatgaatggaacacggttatatcgcctatttctgatagaattccggatgcccatatcggacctattccaggtatggattgaaggatgagcagggcgttagggttcattccgttgatgcatttctcaatcgcctgctcgatcagcttgatttctttctgataggcgtggatgcagttaaacgagcttgccagtgatatgctcagtggttcatacatgcacttgtctaaccggtaggaatccctggctgccttgcgcaggagttccgaagtttttgataggtcagagatgcggttcctgctcttccccgcaaggaaggtaagcagctcctcttccggcatatcgataatctcctgcggagacaaaaattccgtcaggacagctgaggacgtggcaccatagagactgccaaaaggcttgtcatcaccttcaaggagctgaagttcactgaacttcagataaagattcgaaaccatataagtcttctccctggtgatgcactcagaaaggtgcatacggtgccttgtaaggcgtttcagggatatgaactgcccgccgcgccatggctccagttttttcgtgcggcctaccctgccgaagtccgcgatgagatatgcatccgtgggatcggtcttttccattccgatataggattttcggtaattcgaagcggcctttgggtttacacagaatacgtaaggcctgtagggcatgagaacctcgctggccgacaggaagtttgaaatatgcacgctgtatacagaagtagattccagcacgataagaaccgtatccaggtttttatgcttctgcatgcattcggcaatcatatttacaagctgatcggcgcctggctggttattgccaaacgacgatgagatgtatttgttttcctcaaagtccatggcatagacggcattggtctttgagcttacatcaatacctacaaacaaggtggacatatagttgagctttaacatgatatcacctccattccgatggggatttgtgaagcctgaagcaaaaggtttatcctgtgccgcatacggtgaccgaaccctcgcgcaatgagcatgcacccagtcagccttttttgctggggctaacggctggggatgaaaattctgtgtcagcggaatgtgccgtatgtgccaggctgaatgctttcaaagcagtctcggacgaagccggctgaaaggaggagaagcagtgccttcggacatcagactctacctgatatcataccacaggatctacctatattgaaatgtaactatcaactgtatagatgggaatcgggatgaggggagtacctcttagatatccttaccatttatacccaaaaaagaataagtctgtaagcggtttttcttgcttacaaacttattatacgaggaggaccattatgaataaaagcaaaagcagaaaatatcagaaacaaaaaaataataacttaaaaaaatattccaatattaaaaagatagtgattgggctgatagccctgctctgtgtctgcgggctgctgccggaattcatatccggtaggctgctcggaaacagccctgataatgccgattttcaaagtgcttatgttgctgtttccgaagctgtttccgacgtactttcaggtaatattcccaattcaccaaaagctcccggaagcggccgctttgaggatattccctctgtcacggatccgtctgaacggagcgggctcagagtggattttctcgacgtgggccagggcctgtccgtcctgataaatgcagacggccactttatgctttatgacggcggtgacagaaccgcctcttcctttgtcgtggcgtatctgaaagagaagggggttgcaaagctggattatatggtggcctcccattatgacgcagatcacctgaatggactggtaggcgcgctcaacgtcttcaacacggatatgattctcggccccggctacgaaaccgatacaaagatttataaatcatttaccgatacggtacaaaggatgaaaaaagaggtagtccatccgcagccgggagaacggtatcccttgggcgggggatattttgaaattctctcccctctttccgcccaatacgatgatgtaaataattattcgattgcaatccggcttgtctacggcgatacctctattctcctggcaggcgatgccgaacaggaaagcgaacaggagatgacggagtactggcctgacttgaaagccgatgtattatgtgtcagccaccacggttctcccacctccaccggggaagccttcctcgacagcgttaatccttccatcgccgttataagctgcggcagggataattcttacggtcaccccggcaaagcggtcctggagcgcctggacagccggaacatcacggttttccgtactgatgaatccggtaccatcaccctgacgagcgatggaagcgcgctgaccctgccggcatcctgacctttttcgaaccagctgtgtctgagcctgctgtccggcaggatactgtcctaactaaattccttgttaacggtaacaggcgcgctcggcgcgcctgttaccgccggcagttatagcatccggataggacgcttatacctgcctcattttcgggtctaccgcttcttttcgtacattgtgggtctggttctggttttcaggttttactttctgtgtaatactgttaaacttttccaggttctttttctcctgtattttttcctgctgtttctgattcatattatctgtcatctgcttcacctcaatgttagtatgagcggccgtgaaaaaaatatttactttttttcaaatttctcttgctttttctacaatttaatgatatgatatacatcgctcaccattaaacgacatcgaggcgtggctcagtttggtagagcgctgcgttcgggacgcagaggtcgcgtgttcgaatcacgtcgcctcgattgaagatttaaggcctgttggtcaagcggtcaagacgacgccctctcacggcgtaaacccgggttcgattcccggacaggtcattaaagctgttgcagattgcaacagctttttcatttaacaggaaagtacatctgcgcgcggagcgtgccggttatcgtttaacataaaaacggtccgcagtttatagccgcggaccgttttttgtaaaggaagaacaacgtgacgtcttttaagctctgtttacgaaagactcacagtcagtacattctttctgagtcgggttggcctcgtgtgtaccaactttaatcctctctaatgcgcagtagtttgcgtcctttgcatggttagcgcagttaacaattgtacattcgatacaagtattctttccgtttgttaccataatgagtatgcctccttaaatagattttatattattatctgcataatcgtacgatttatgcgcggagggcaaacggaatttttttacatttattcgtttttgactttatcgaaagacgggttaaaagcataaaagttcttgctgtcgagatgatcctggagatccctgagagcctcgccgaaacgctggaaatgaacaatttcacgctctctcagatatcggatcgggtcacaaacgtcagggtctttaacgacacggaggatgttgtcataagtggatcttgccttttgttcagccgccatatcctcaaagaggtcggtaatcgggtctcccttggactggaattcacatgcattgaaaggtattcctcccgcagcctgcggccagattcctgtcgtatggtcaatataatacgggccgaaaccggactctttaatctgttccggcgtcaggttccgtgtcagctgatgaataatggccgccacaatttccatatgtgccagttcttcggttccgatatccgtcaaaaggccttttcccactttgtaaggcatggaataccgctgggaaagataacgcatggaagctccaatttctccgtccggaccgccatactgactcataataaactgtgccatctgtggattggactgtttaatttttaccggatactgtaaacgcttttcatatttccacataccttacatctctccttcccatggccatttatctgtcagccacgtccattttgaatcgctctcaactccgtcggttgtaagagggccaaactgctgctgataggcatccacggcttctttccgcagctgcactacatagttataataattcagagcgttcatatcatccgggtgcgtatccaggtacaggacgatatcgtccacagcaaagctcgcttcataaattctctgcattagcgttctggcagtttcgttcatttacatgcacctccccatcacaaatggcagatccagctctgtgaatatcgttcccctgcaaaagccttcatcaaggggagatggctgagaccatctctgcatcggcacatagcccatgccgatcgggaagcgatccaaatcttcgcagaatgccatattattctgtccctgcgccatattgccgggcattgccggcatagctcccatgttcgccggagccgtttccatgtttgcaggagctgctcccatgtttgccggagctgttcccatgtttgccggagctgttcccatattcatcggagctgtctcccccggcatactgcccattctgcccattccatcccgtacgctgccgctgcccgacggcatagacgtatcagcaggcatccatggtgtgcggcctgactggcgggagttcgattctgatcgcggctgtatcattgtgggcggcattccgcagggaggatatccctgatccatgtaccaggatgacatatcaggcatgggatcctgtcttctgaaatccattccgtccggataatgaggattaaaacaattcatattcattaaaacctttcctgagacttatactttatactatgttgcggaaagaaaattgacaaaaaaagatgcgaaaaggaccggctgacggccatttcgcatctttaaaaagcttctgtctatctgttattttgttacagttcagccttcggccaaactgtaacaaatgatgcacagaaacggctacaagcgccgttgattgtggtgaaaagtcaaaaacagcgaaaacacctcgcggaatacatcctggctgagctgtttcgttattttcttgtctgcagctctttttccttttctttacaaaggtatttaatgatatcttttcttgttataatgccgataaaatttttctgatcgtccaataccgggacaaagttctggttcagggctttatcaatcaaatcttccatatcggaatccgcaagaaccggtttattgtccgatcttcttggaatctccgtaatgcggatccgctccgcatctctcaatgataaatcatacttatttttaataccccaaagcaaatccccctctgtcagcgtaccgatgtaccttccctgacggttaactatcggaacagccgcatatttgtgaaattccatcgtctccagtgcctgtctgagtgtatcatcatcatttatgtacgcaacttcacttttaggtgttaaaaaaaacaaaatattcatctgccttctccttgtgtgttctatgctgtctaagcacggtactattataacgctcccctttgaaaactttgtgaacaaatcatgatatttccattagatttattaaattttaagaaatacccccggggcgtgtctgattaatatcccagagcctcgtccacaaatactatctctgcttccatcccattcgacggacgctcgatgattacggttgaccggcagattcttcccgggctgctgcagtcatagcagcgatcccccttagccgcacacggcgtagccgaaccgaggcggcaggcgtttttcggcgccgccacattcttagcccgttccattgccctggcaagatccggctctatcttattgctccccacaataaaatatattttttccggtccatagagggtctgcgaaacacggtttcccgttccgtcgatattgaccagttctcccgtctcggacactccgtttgcactggccagatagacctttgcctctcttgcctgcagcagagtctctcttcccgggatatcccaatgccaaatcacctcgttattctccctgagacgctcggccagccccatctccttcaccgtaatgctgcctccgatcgaaacgctggtctctctgatccgggcggaaagataatccgccgcctcttttgcagtactaaaaaaagctgttttaaaaccatgattttcaaaattctgtttcagtatttcctgattcatagcacttctccttgcaatataatcgtaaattaaattgattcacagctctgctctgattattataaccccagttgtgcctctaagtaaacatgaaaagatacaaaaataccgccgcactttatgcaaggttaaatttcctttcccttccataaactgccgcggcacttttatgattatcattattcagttttctcagttccttctgtcttcccgccgaccggttactccagataatccagagcgtcaacaggctgcccttcatgcattaactcgaaatagacgttattgccctcgattgaatagtattttgtaggctcagatacatatcccagcagagttccttttgtaacatactcattttctgccacctggatatctttgagctggccgcatacggctgtgtactcgttgcccaggtccaggactacgtaattaccgatctcctcattggagcctgactccagaactctggcgtctgccggcgcgcttaccggatcgctgatatccccctggataatcagggccggattgcatttgtactgatcgagagtcgggaagtatacggttgtctccatactgtaatccaacactacatttcctttgacaggccactgcagcgtgcgctggcccccgaaattaagtgtcactgcctgggcggcgccgtttccggctcctgctgcttttgcactgttttctcctttgtctgcggagtctgatttgtcatcggaagaataggaagcgtctgagcttccggccgcctgggcttttgtctcagcattttccgtactgccgccgtttccggttttgttctgcggtatgttttccgcaagaattccctgagtctgagggacttccaggtacggattctgctcgttaatattatctccctttctaatctttaccgctcctgctgcagctactatagtcagcaggcctaacaccatcatcacaaggaacaatttgtccttgaacaactgattcatcttatttttcacgtttatcacctcggttatattcttacctgaccgaagctttttattcaaaaactacaacaatatttttataataaaattccagtattttttcagccgtccacccctccttcgctttcaggccggcgccgtactggtcaaaaccgtaaccatggcctatcccctttaccgtgcatctgatattgccttccgcctcctcaaatgaatatgccggggacggaagccccagggcatattgtatctcctcgcctccatagctttttgggcccacctggatggattccacatacccggcctcgtcttttttaatgacctggatactttccagcacctcctccggcctgacttcgggcgaatccggcatcgagttaagcctggcggccaaatcctcccttgtaaacagatatacgcccaggtagttttctccctccacatccccggcggcatccacctgtaccagatagggatgaagttcatccccgtttctcgtcatcccggcgctcagcctgtggaacaagggatctatgtagtctccattatattgtatcacctgtccggccgtcgcctggaccgcatcccttatttttttgtaatttgccagataatcggctttcccccacatttcctccatctggctctgttccagatagtcgaggtccagcgccgactcttcaatccggtccttcccctgcatctgcttgcagagataagtcctggctataatcgcctgtgccttgatggcttccatatcatactccgccggaatctgcagtgccgtaattccaatcaggtattcttccatatcgacaggcgccggggaaccctccctgtccagcaggattgtgcgccccgatacggcgcctctgtctgtatttccctccacccggcctgtccaggccagtgtcgttatatatggtatcaggattgccaacaggcaaaccgctgctgcttttctcataaaaaatccggctccgttccacagaataatagatctcgcattatcattctatgttacgggccggatttctattccaaccgcttatttttaactgcctgtgaacacttcttccgctccgtcatctagccggcggtaaaagcctccatcttccatttcagaaaaccggtctttttaagggtaattgttcccgtgaagctcttctgcaccacaggcgaaacctcctccagtcttctctccagataaaattccgtctccaccgtgtaccggtaccgcaccgtcttcccgctctcttcctccagagccagaaccggttcctgcgcataaatccgctctacaggcgagggaaactgctccaggaacagagtgtagggtattcccacgggaagcaggctgtccctgccctccggggtaaaatctcccggaaaatgggtgtcatacatctgtggcaggccaatgtttgcggcctcctccagttccctgtagctttcggatgtaaataatttttttactatccgctccgcctgggctctgctgctggctgaaaatgtaatatagcagaacacagacgccagaaacaggcacgccgccaggatgaccggcagggaaattcgattattcctgttcttaaaatggttcttagaaagaaaaccggttctcatttagtctaattccacctttacctttttaaggtgccaaatgtcccttacatattcctcaatggttctgtccgaggagaacttgccggaacaagccacattcatcatcgccgcttttgcccattttgtctcatcacggtatgccgcttccactctctgctgcgcatccgcataagaatggaaatctttcaggataaagtaggtatcggctttcgcactgtttttcgtattcaacagcgaattataaatgtcgcggaacagctccggatcctgcggtgcatagtagccgttgattagctgcatcagcacacggcggatttcctgatccgtattaaagatctctaccggattatagcctccgttattctcaaagttaattacttcgtctgaggtaaggccgaaaataaaggcgttgtcctctcctacctcctcgacaatctccacattggctccgtccatggttcccagtgtaagcgctccgttgagcataaatttcatgttgcccgttccggacgcctccttgctggctgtggaaatctgctcgctgacatcggctgcagcaaaaatgatctcggcattggataccttgtaatcttcaataaagacaacttttatcttaccgttaatcgatttatcattgttaattacatcggccacagagttgattaacttgattgtcttcttggcaatctgatatccggcggccgcctttgccccgaaaataaaggttctcggaaccatatcgatgcccggattatccttcagctggttgtaaagatacataacgtgaagaatattcaaaagctggcgtttatattcgtggagccgttttacctgcacatcaaaaatcgagcggggatttacatcgatgccattgtgctctttgatatattttgccagacggagtttattctgatatttaatattcataaattcctggcggcacttctcatcctccgcatagattgccagcttgctgatatggggcagatccgtgatccactcattccctatcttatcggtcacccactgagccagaagcgggttgccgtgaagcaggaaacgcctctgggtgattccgtttgtcttattgttgaatttttccggcatcatctcatagaaatcgcgcagttcctgtttcttcaggatttccgtatggagcctggctactccgtttacggaaaatccggccacaatggccagatgtgccatcttaacctggccatcgaagataatcgccattttctttactttttcatagttgttcggatacttctgcccaacttccagcaggaagcggcggttgatctcctccacaatctggtagatacgcggaagcagcctggagaacagctcgatcggccatttttccagcgcctctgccatgatggtatggtttgtgtaggcgcagcatctcgttgtgatatcccaggcgtcctcccactccagatgttcttcatccaggaggattctcataagctccgcaaccgatacggtcggatgggtatcgttcatctggaacactaccttctccggcagcatatggatatcttcattctgctctttgaattttttaatcgccacctgcaggctggcggagttgaagaagtactgctgcttcaggcgcagttctttgccggcgtagtgattatcatttgggtagagaacttcaacaaggttcttcgccaggttttcctgttccactgccttctggtaatctcccttgtcaaaggcggtcaggctgaacgtgttaatcggctgcgcatcccagatacggagtgtgttgaccacgttatttccatagcctacaatcggcatatcataaggcactgccaaaacggactgatagccttcctggacaaacacattgcgctgcccgttccagaccgtcttcacataacctccgaattttacctccgttgcatattccgcacggcgtatttcgaatggatatccgttcttcagccattcatccggcacttcgatctgataaccgttttcaattttctgcttgaacatgccgtagtggtagcggataccgcagccataggccgggtatccaagcgtagcaagagaatccagaaagcaggctgccagacggccaagaccgccgttgccaagagccggatccggctcctggtcctcgatggcgtttaaatcaaagcccagctcttccagggcttcccttatctccttctgctcgcccaggttaatgatgttattccccagggcacggcccattaagaattccatggacagatagtaaaccttttttacctttaaatcatcgaatgttttctgcgtcgcaatccagttatcgataattacatcctttaccgcataggcaaccgcctgatatacctgctgcggcgtcgcttcgtcaatcgtctttctgaactggttcttcacattgtcaataatactcttctttattgcttccttatcaaaagtctgcatctgttatcctcctaatcagtcggtggttttttcgactcccagcataaccttttcaccgttgatattccattcttttgcatatcctccggtctgtccgagcatgatgttgtctgccagaacctcgcccttgatttcgtccgtgtattttttgaggatgccggcaatgacctcattctcatcctggaaaacattaatgtggttcattacttcaaaaccggcttctttacgcattgtctgaattttgctgataatttcgcgcacaaatccttcctccaccagttccggtgtcaggttcgtatcaaggacaacggtaatggagttgtctccctcggaaatgtagccttccacctgagccgtatcgatcagaagatcctcttttgtcagaaccacatttgctccgtcaaagtcaaatgtcaggcttccgctctcattcagcgtatccatcgctttatttccgtcgatttcagccagggcctttttaatactgcccagttgttttccgtattttggtcccaccgtcttaagctgaggtttgaaactgtaggatgtgaaatcgcgcacatcgctggtaaatatcacctcttttacattcagctcatcttcgataatctcctggtagaattccggaagagctttttccgcctttacgaacatcttgccgatcggctgacggttcttaatattggccgtatttctggccgcacggccgaatacgacaatcttaagcacctcatccatcctcgattccagttctttatcaatgcagttctcatccgccgcagggaaatcgcacagatggatgctctcaggggcatctttgtcgatcttcctgacgaggttctggtagatatcctccgtcataaacggaaccatcggagcggccgccttgcatacggtcacaagtgcggtatagagcgtcatatatgcattaatcttatcctgctccatcccttttgcccagaaacgctcgcggcttcttcttacataccagttgctcatatcgtccacaaaatcctggagcgctcttgcagcttccggaatcctgtaatttgccagatcgtcgtccacttcttttacaagcgtgttcagcttggagagcagccacttatccataaccggcagtttatcgtactccagtttatattctgttgcatcaaaattatctatatttgcatataacacgaaaaatgcataggtattccagagggtacccatgaactttctctgtccttccattacggccttgccgtggaatcggttgggcagccatggcgcgctgtttacatagaaataccatctgatggcatctgcgccgtaggtctccagtgcgtcgaagggatcgaccgcattgcccttggacttgctcatcttctgcccattttcatcctggacatggcccataacgataacattcttatacggagccttattgaaaatcagtgttgagattgcaagcagggaatagaaccagcctctcgtctgatccaccgcctcggagataaaatcagccgggaactgctgctcaaacaaatccttattctcaaatgggtaatggtgctgtgcaaacggcatggcgccggaatcgaaccagcagtcgattacctccgggacacggtgcatttctttgccgcactccggacaggtgattgtcaccgaatcaatatacgggcggtgaagctcgatatcatccgggcagttgtccgacatgctctttaactcttcgatgctgccgatggaatgctggcagccgcactcacactcccagatattgagcggagttccccagtaacggttacggctgatgccccaatcctggacattctccagccagtcgccgaaacgtcctttaccgatgctctcaggaatccagttgattgtattattattgcggatcagatcctccttcaccgccgtcatctggatgaaccaggattctctggcataatagatcagaggagtgtcgcaccgccagcaatggggatagctatgctcaaacaccggggcggataacaacagccccttttccttcaggctctgaagcaccatcgggtcagcctttttgcagaatacgccggcacatggcgttccctcttccatctcgcctttggagtttacaagctgtacaaaaggaaggctgtattctctgccgatcctggagtcgtcttcaccgaacgccggggcaatatgaacgactcccgtaccgtctgtcagagttacaaagtctccacaggtgatataataagcttttttcttctgttttttgcagatttcaagggcacagtcaaaaagaggctcatattctttatattccagttcttttcccttatagcgctccttcacctcataggtgtcggcgcccagtaccgcatcgcagagagcctcagccagatagtagacggttccgtcctctttcattgccaccttcacatagttctcatttggatttacgcataagcccacgttggaaggaagtgtccacggtgtagtggtccaggcgagaacaaatccctcctcatcctttaacttgaacttaacaatagcggagcgctctttgacatccttgtagccctgcgccacttcatggctggaaagcggagttccgcagcgcgggcagtacggcacaatcttgaagcctttatataaaaggcccctgtcccagatctttttcagagcccaccactcggactcgatatactcattgtggtatgttacgtaaggatcttccatatcagcccagaagccgacggtggaggaaaagtcctcccacattcccttgtatttccatacactttctttacaatgctcaataaacggttcaaggccgtacccctcgatctgctccttgccgtccagtcccaggctcttctctacctccagctccaccggaagtccgtgcgtatcccagccggcctttctcggtaccatatagcccttcattgtccggtatctcggaatcatatctttaatgacacgcgtcagcacatggccgatatggggttttccgttggccgtgggggggccgtcatagaatgtgtaggtttcgccctctttacggctgtcgatgcttttttcaaagatctggtggtcttcccagaacttctcgatgtttttttctctttctacaaaattaaggtttgtagagactttgtcgtacataattgcttcctcctaatctctgcttataacgatataaaacgataactgcaagctcgcgcacagctcaccgccatcaaaaaaacaggcccctatcccgtaacaggacaagggcctacttgctataccacctattactgcatacttccatatgcgctccctgtaacgggggatcccgtcaagacttactcataccggccgcctgaaattactctcctctgccgccgggttcagtctgaaactccggagtgattttcatatccgccctactcacaaccggcttccaccgccccggtctcgctttggctttcctgtcggaactactgtctccatcaaagtttttccttattatttccattaattatttttgcaatccttagccttttaattgtaaacactttccatgcagttgtcaagaccgttacagtcccatttatgttgccacagcctttttacacgaaaatccggggttacacagccaccttccatctgtttttgtcctgatctgcaaaattatctgatatttttttatcacccttttatttttttccaaatttgtggtatactatgagcacttggtgaggtattttgaaatccttcgggtcatacccgaagactgaatgagattttccaatcgtacccgccaccatccaagaagataaaactaaggagaaaatcatgtaccaaaggaacctgacactactgacagacctgtatgaactgacgatgatgcaggggtatttcaaggaaaaagacgccaatgaaactgtcatttttgacgctttttacagaagcaacccggatggcaatgcattttccatctgcgccgggctggagcaggtaattgaatacgtaaagaatcttcattttgagccggaagatgtggactatttaaggagcgtgggacttttcgacgaagacttcctcgactatcttctccacttcaaattctccggcgatatctatgcaattccggaaggcaccgtcatgtttccgcgcgaaccgatcatcaaggtaattgcgcctatcatggaagcacagctggtggagactgccatattaaatatcatcaaccatcagagcctgatcgcaaccaagacatcacgcatcgtctatgcggcacgcggagacggaatcatggaattcggacttcgccgcgcccaggggccggacgcgggaacctacggcgcaagggctgccatgattgcaggctgcatcggtacttccaatgtcctggcgggaaagcttttcgacgttccggtcaaaggcacccatgcccatagctggattatgagttttccggatgagctgacggccttccgtacctatgccaagctgtacccgtccgcctgtattctccttgttgacacctacgatacattaaattccggagttcccaatgccatcaaagtattcagggaaatgaaggaagccgggatccctcttaccttctacggaatccgcctggacagcggtgaccttgcctatctgtctaaaaaagcgaaaaagatgctggatgaagccggtttcccggacgccaccatctcagcttcaaacgacctggatgaatacctgatcgacagcttaaaaatccagggagccaccatcaattcctggggtgtgggaaccaacctgattacctccaaggactgtccatccttcggcggcgtatacaagctcgccgctatcatggataaaaaaacaggaaaattcattccaaagataaagctttccgaaaatacggagaaggtcacgaacccgggcaacaagacgatccgcaggatctacgacaaagaaagcggaaaaatcattgctgatttgatttgtctcgtggatgaggtttatgatgagaataattcccttcttctctttgatccggtggaaacctggaaaaagacacacctggctccgggctcctacacgatccgtgaactgcttgttccggtatttagaaacggggaatgtgtgtaccagtctccaaaagtaatggaactgcgggaatactgcagacaagaacaggaaacactctgggacgaatcaagacgtctcgtcaaccctcatgaaattcatgtagatttgtcgaatgaactgtggcatatgaaaaaccagctgctggacagttatcattataataattaggcgctccgaataaagccggggccatgtcaaacaccccgccgtcatccagccggcggggtcttcttcttttacacatatcccatatcagccgtcggaaccggcttcttccatcttttggatccgtttttccagctcatcgaccttatcggacattttcagacaggcagtaatgagccaggtcagcaaaaaagcggcggcagccagcaaggtccaaaaattagataagaagaaaaaagcaaggatgtaaagccccaaaaaacaagtgataaatattcccaagaagttcttcatgcgcacccccttattcttgaaatgaatgattctcagctgattatatcaaattccacaccaaaaatacagagcgggcgggtcacttttccagctctttaagcatgatcggaatgtgcacgaaaacacctcgcgaatacaatttaactgaggtccggaggacgcgtccggaacggaccatgtccggtgtggcaagggagggctggatgagtcttccgtccctgtgggaggttatcgcggagggggaatccggccggaatgaattgctgcggggaccgtttgcactcttaggagtgcgcatcggaatgctaagctcgtgagggacctcgctaagcaccggcggactcccaggtccgcgcacgcaatgcggacattataccatctctgagggatgtgttttatacgttgcgagacttaccgtcacaaggacgacagcgcagaccagggagcctggaaccgcagagcccagtccccatggttttcctatcaaatcccagccgatactcacaacaaagctggaaacaatacttgctataattcccgcattggtggcttttctccaatagagcgccgccaaagccggcaggcctaccgatgcggcgtagaaggtccatgcaaacatcagggcattatacgcattctttatgtaaagggcgataatcaatgctcctatcgcaagcaccgccgacaggatacgggatatgaatacttcccttttatcggacattttaggattcagcgtctttcccaggtcctgtacaaaagtctgtgtggagataagcagataactgtccgccgagctcatcataaccgaaagaaggcccgccagacaaagtcccgtgataccgaccggaagaatatggattaccagccccggaatgacggcctccgcagttccgtaaagctctttcacattcggcaggatctgtcttcccatcagccccagcatcaggataataaaaatggtgcatccatagatggaggtaccccagaacatcccctctttggctgctttccggctcttggccgcaaatgcccgctgccacatctcggcccccgccatcgtaaataccaggtatgttacaatatccccgacgaccttgccgtcgatgttaggaatcagcatctccttcggaacattactccaaaaattcccaaagccgccgagatatcggatccccgaaagcggaagcaggatatagacaaaaataatcagcatgaaaaactgcaccacatccgtatacactacgccgaacagaccggaagccgccgtataaaagatgaatataaatgttgccagacatgctcccatctcgtaggtaatcccaattttaccgccaatcattttcacaattaccgcaacggcagtgatctgggatgccacagttcccatcatcgtatagccgatcagcagcgcgatcaggcattttgccgttttactgaaacgtttttcaaacagctccggtatcgacgtaatattatactttacgcctacctcctgaattcggccgctgattccggaaaacacaaacattccgatcagataaggcagagccgtaaccaccgcaagggagccataatcatatcctagtcccgctcttcccatcatcgcgcttccgccgataatcgttgcacataccgttcccgccaaaaccagagggccaaggctccggcctgccacataatagtcacctgcattctgaatccgcctgacgaaataaactccaatcccaagcatccccagcagatacagcgccactattaccagatccagtgtcgtaatgttgctcaaatcctgcataagcaaccctcctttatgatatttttatagaatcagcatcatctcaaaaaaggctgaacccgtctttctcctaagatgcattcttcttttcgtttttccttacggaattcccatggaaaggactcccatgagcaatagattcaatatttcaatagatttgataaaatagaactaagattcccctgttatcaggtaatataatcatctgtaaaatattatagcattattttaacaatgcagtcaagatttacctgtacaaagaaggttggacgccgccgggatgtccagcggacggggcggtgagggtgattggatgagtcttttgtcccggggtgaattgctgtgagttgggactgcaaagaagatatagtctacggagcacgtgttcactcggtggaatgcatcggccccgtccaccggcctgcggccgctggatcaaaaaatgatgccgccggttctccctgcagcatcatttttctattctttattcgtcccagttgtggtaagttgcctggacatcgtcatcgtcatccaggagatccagaatccggttcatctttttgatagcgtcatcgtccgttaactctacccaggtctggggaatcatcgtaacatcggcttccatcattggaattccttctttttcaagcgcttcacggaccgctgaaaaatcctccggggctgtgattacttcatagctgtcttcctcttctgcgaaatcttctgcgcctgcatcgagagacagcatcatcagttcgtccgcatccatctcgcactcttctttgtcgataataatctggcccttcttatcaaacatgaaggagacgcttcccggcgttccgacgtttccgccgcccttggtaaaggcgcttctcacattggcagccgtacggtttttattatcggtcagcgcatctacgatgatagcgacgccgttagggccgtatccttcgtatgtaaggttttcatagtttacagagttggcatctcccgccgcttttttgataccgcgctcaatcgtgtcgttcggcatgttgttcgctttcgctttcgcgattacgtcgcgaagacggctgttgttggccggatccgctccgccctcttttacggcaacggcaatctcacgtccaattacagtaaaaatcttgcccttcgctgaatcattcttttcttttttgtgcttaatattggcgaactttgaatgtcctgacataaaaataacactcctctttctataataaaatatgatttccggatcacaccgtgtgctcccgggttaaatattacatggtaattatgctcacaatctttactattctagcactaatgggatgggagcgcaagtattttccggttattatttcattcaatgccccggttcatcgcgctgctaagtccgataggaccttactaatcagcgatggattccaaagacatccgcagaccgggacgaaagactcagccagccccctcaccacaccggacatggtctgttccggacgcgtcctccatcctcagccaataagtctgcaattatgcttaaccctctcttccctccccacatacaatagtagtatattcttttaatcaggagacttaaattatgcctgaatcagctatgattatcacgccgctccatattctctatctcgtgggagtggtttctgttctcgccgtaatggtcctgaggcgggatactcctctcgtatgcaccctgtttctttttctgctgggcgctctcgggctccactcttttatcggcggtattcaaacggtatttaatgccattttatatgcagccagggaatttatggagatcatcgccactatcgcactggtcaccgccctttctaaatgtatggcggatctgggaagcgatcgtcttctgatggagccgatgtcaaaggtaatgaaaacaccggcgcgcacctggtggcttctgggtgttacgatgtttctgttttctctcttcttatggccctccccgtcagttgccctcgtcggcgcgattatgattccgtttgccgtccgggccggactctcacctctggccgctgccatggccatgaacttgtttggccatggttttgccctaagctatgatgtggtgatacagggcgctccggccatatcggcggcagcagcgggaatttctgcggccgacatcctttcccaggcatggccggttttctgggttatgggcggcgtcaccgtcctggccgcctttcttctgaacaggaaatccatgggtacggcaaagctttcctcaagcggaaatgtcgtaaataaacaggactccgggagccagggcaattccagggcagctctggcgctggcagccgccgttcccctcgccttcctggcggatattgtatgcatgctggccctcgacttaaacggcggagacgctaccagcgttgtatccggtacagccgtcctgcttatgtgtttcggcgccgtactcggttttggaaaacagtcgcctgagaaggtcacgcgttatctgaccgacggctttctgtttgctatccgtatttttgcccccgtgatcgttatcggggctttcttctttctcggaggcggaggcatcacctcgattctcggggaaggttttggcgacgggattttgaatgactgggctgtctggcttgccgcccatactcctctgaatccgtatattgccgcttttttccaattgattatcgggtgtctgaccggtcttgacggctccggcttttcaggtcttccgctcaccggcgctctcgcccataccttcggaaccgctactttcgcctctgttcccgtcctggccgctctcggacagattggcgccatctttgtaggcggaggcaccatcgttccctggggactgattccagtggcagccatctgcaatgtaagcccgattgagctggcgcggaaaaacctgccccctgttctgattggcttaacggcagcttttatagcagcctgcctgatgctggtttaatacgtttaatacgtaacagttcagccatgatgtattccgcaaggtgttttcacagttttttgtgaaaatcccgatttatgcggcgcggagtagtttgaccgaaggctgactgtagctttacctgtaagtaacctgtacacacagtctagatttaaggaggaattattatgtgcggaattgccggctttttcaacccggaaatggattttacgaaggagaaggtgtataatctgaatattctggatgccatgaaccaggcacaaaaaaggcgggggccggatgacgagggtacgtttttaaatgaacatttcggtctggcccaggtacgcctggctatcgtcgatctgctcaccggccatcagcccatgctccatcggtccggatcccggaccttcggtatcgtatataacggagagctttataatacaaaggagctcagagatgaattgaaaacggaaggagcggcctttgacacggacagcgatacggaagtcctattaaacgcctatctggcctggggtaccgattttatcagcagggtcaatggaatcttttcactcgcaatcatggatacggcaaaaaaccaactccttctttaccgggaccgctccggtatcaagccgcttttctatacggcctgcgaggagacgggaaccgttcactttgcttcggaactgaaggcgctcctggcctgcccgggtatccgccccgaaattgacagggacggactgaatgaaatattcagcatcggcccggccagaaccagcggctgcggcgtctttcgaaatatcaaagaagtgctgcccggccattttctctgctgcactccctcaggaaaccgtcttaaagcctactggaagctgaaaagcctgccgcataccgattcttttgaagatacggtggaaaaaacaggtttccttctccgggacgccgtaaaaagacagatggtttccgatgttcccatctgcacctttttgtcgggaggcgttgattcctctcttgtctctgcgatctgcgccagagaactggaaaaccggaaccagaagcttcacacttattcctttgacttcgcgggaaatgcggaaaatttcaaggccagctccttccagccctcccaggatcgtccctttgtagacaagatggtagatttccttggctccgagcatacgtacctcgaatgttccaccaaagaccaggccgatcttctcttcgattcagtcagggcccatgatctgccggccatggccgacgtcgattcttccctgctctatttttgttcccttgtcgccagaaagcacaaggttgccctgacaggggaatgcgcggatgaaatcttcggcggttatccctggtttcataaaaaggaatgcttcttagcagacaccttcccctggacgatggatctggaggcccgcaaggttctgctttccgatgattttctcgattttctaaaaatggaggattacgtaaaacacgcatatgaagcttccgtggcagaggttccgaagctggccggggaaggcgcggaggaggccagacggcgggaaatctcctatctgaacctgagatggttcatgcagacgctgttaaacagaatggatcggaccagtatgtacagcgggctggaggcccgggttccttttgccgatcaccgtattatagaatatctctttaatgtcccctgggatatgaaggcccggggcaatattgtaaaagcgcttctgcgggaagccggccgcgggctgcttcccgacgagatactgtttaggaggaaatcaccctatccaaagacttatgacagaaaatacgaagcgctgctggccggacgtgtccgtgatatcctaaacgactcttcctcccctgtgcttggctttgtggacaaaaagaaagcagaacgctttctggaaagcccgtcggattacggtaagccatggtatggccagcttatggcagcgccccagcttatggcctacctgattcaggtggatttctggattcgcgaataccatgtaaccgtaatccggtaattaccgggtcagcgttctgctacctgttaaagttaaaatgttcccgatcctcctccagaatcaggtcactcctgctgtccgcgtccgtaatgaggcggatcgggcggcagggattgccgtaagccagataatgggccggaatatcctttgtcacgacgctgccggccccaatcacggctccgtcgccgattcttacgccgccaagcactactacattgcaggccagccagacgttatcgccgatatggatttcttctgcaaattcagccatcgttgtgctgccgttcctatccagtccaactctctctttagcaatcaggggatgatttgtggccatcagcgatacattcggcccgaaacagacattatctcctataaaaattctcgcgtcatccatcaccataaggttgaagttggcaaagaaattctctccgatatacgtatggctcccatagttaaactgtacaggcccctggaaataacatgttcttcccattttgccgataatcccgcgcagaaccgcaatccgttccggatcgtattcatccatggcattgtaacggcggcatgcctcatgagccttatgcttgatatccttcagttccgtctttctcggatcaaacatttttcctgcaaaaatcttctcttcctcgttcataatttccccctctgaaatttgctaccatctccctgaaaaaccaactctgaatccccgtaagcctacccctgaatctcaagcgtcaggtttttcagccactttttctgtctgtaacggatataacttaaaattgttttataaacctcttccagagtaaccatcgcataaactatgtaaatcggctgtttcagcaccaggccgccgataaaggccatcggaattccaatcagccagacgccgctgcagtccaggaacagacagactttcgtatcaccgccgcttcgcagtacccccactatattgacatagttaaacattttaaacggcataaacagcgagaagacaatcagacagagactgacatcccgggccacttctccgcccagacggtaaagatcgataatctgccaccggactcccgcacagataaaagccatgataaccgtaacaataaactggagtatcaggaagtttttcgcataccgctccgcctttttcagatggccggcgcccagctcatttccgaggataaccgccgtcgctgcgctcagcccctggaacaggacagacataatatcctggatcgtcgtagctaccgtaatagcggcaaccgcgttatcccccatgcgcccatacgccagagaatacatcgtaacgcccagcccccagataaattcgtttgcgataaccggggaggccgttgcgaagaatttctttacaaatgaggccgaatagccgaacagctctctgggccggcatgcaatcggagatttcttcagatatacgacaagaaggagggccgtcatttccacaatacgggctatcagcgttgccagtgccgcgcctaccacgcccatggccggcgccccgaatttgccgaaaataaacatataattgaaaaaaatattaattaaaatcgtgcagctgcttattacaacgggagcttttacttttcctaccgccctctgcatcgcaacgtaagtgttgctgacggcaataaaaggataggaaagagcaaccagggacaaataggatgccccgatccgtatggtatcccctccagtcgtaaagattctcatcacatgtttcgggcatgcgactgccggaataaagaaagcaagcgcggcgccgattgccagaagcagcgccagccccaggactttcctgatatttttcacatcattatttccccagaactgggctgccagaatcccggaaccgctgacgatgccaaacaccagcagcgtcattacaaaaaacaccttgttggccaatcccaccgcagcgatggaggtggcccccagcgagccaatcatcatggtatccaccatgtttacaattgtattcagcatgccctgcatcgccacaggcagtgctattcttacagccttggaaaggaatatcctgtccgtcatcataatcttcgtatcttgcagtatcgctctcataatccccttcttccaaatcagtccgccccgctgcgacaaaaagcacagatgttttttaccgccgggccatcaaaagaacgcccgggccacgctcaggcgttcatatacttaatttttcacttccgtttcatcttttttctccaaaacaggaaccgccgtcacggcatgaatcatcttattctcaacagaaagcactttgaagaggtaatttttatattccacctcaagctgctccccttccttgggaatgcggtccagcttggaaatcagaaatccgttgagggtatcgtaattctcgtaatcctcctcatcaaattccacatccagggcttcccccacctcgtccagcggtgccagcccgtcaaaaataaaacttccgtcatcacgtctggatatatattcctcatcctcgtcgtattcatcgaggatattgcctactatctcctccagaatatcttccatcgtgacgattccggctgtctgaccatactcgtccactacaatctccatatgtattttctgggactgcatttccttgaacagcgtgtccacatgtctggtctcaggtataaaatgggcgtcgcgtaacagcccgtccagctcttttaaattcttccttcggttctcttctttctctgcaaagcccagagcatccctcatatgcaggattccgatgatatcgtcgatatccttctcaaatacagggaaacgcgaattgttggcctccgtgagaatataagtaaccgcttcgtccagtgacatcgacgcatccagcgccgttatattcgtcctgtgtgtcatgatatctccggcttctttgtcattcagctcaaaaatattcgtgatcatctcggcctctccggcctccagaactccctgctcatggccttcattgaccatcagcataatatcttcctgtgttacgttatcgtcatcggaattcaaatcaattcccatcggcttcagcaccagtgccgagagcgccgatatgagaaatgtaaacggcctcagcaggatcacaaacacctgcacgattgaaaaaacaccgtatccccacttctccggctttctggccccgcatttcttaggaatcacaatgccgaaactgataagcaccgccagcactatgacgccggccgccgccacactcgccgaataaaccagcatctcgtggccgtcctccgaatgcttcacaagcatctggaaaagctggccgagctggcgcatcacataagcaccggccactattccgattatattcgtcattacctggaccgtattgataaattcgccaggcttattgatcagcctcaaaagtttcccggcccgttcgtttccttcttccgcctccttttcaaggctgtttacgtttaggttctgtatggctgaaccaaatccgtataaaaccgcgtcaatcagaataaaaccaaccagtatcagtatacttaagggccaatacccatcgtccatatttctttcttactcctttaaactgtgatggtgtaaagtctgctgaatacagctttccatcgtttctttcgtacatttattaacgatctttgcaaaagcggcatataaaccggcccgtgcaaaatcctttacggaaaataaatcctgacatctgtcactatatcatcttttaatgaggttcgtcaatgataacctatgtatccagctcaaggcttatcatcagcgcacgatccacgtcttttaacagctcgtcgtcaatatggcagattctttctttcagccgctgtttgtctatggtccgaagctgctcgagcaggattaccgaatcccggatcatatcacacctctttgtattcagctccacatgggtgggcagcttcgctttattcatctttgatgtaattgctgcacagattacagtggggctgtgcttgttccctatatcattttgtataatcagcaccggtcttacaccgccctgttccgaacccacaaccggtctcaaatctgcataataaatatctccacgtctgataatcaatgttctcactctccgtcaaattcttcatgtccttagtattgacctgttttgacccgagtattccgtcaaccggatacttttttcagcgccgtcatcccctattgatttatcatatgggaaaaacaggctgacagttcacggaaaagagaaaaattgaatttaactgagattggggaggacgcgtccggaacggaccatgtccggtgtggtgaggttttggctgagtctttcgcccccggtttgaggttgttgtgagggggaatccggccggaatgaattgctgcggggaccgtttgcactctttggagtgcgcctacttccccggtcaggtttgcgccggggacggaagactcaggcgaaggttttcgcgacaccggacatggtccgttccggccgctgattgtctctaaccttaaatggagaaggtcctgtcgcggccactacgtgtctccggcatgctgatatcatatcttccacaatttttttataataggtgcatcgaaggtttatcgtttttcgttcacggaagctcttagttgccgcgacaaggtccgctctccgcacttaacgcgtgagatattcagcggccgcaggccagcggcgtcctcacctgctaattaaataaaatcttcatatttatcgtcccaataatctttcctgcccacctcaactccatgtcttatatataccctgggaacacgttttcccagcacacaggggatctcatagcggaaaccgccgcagaggtcagccagcctttccattgacagcatctcgtccctgtcccgtccggccagtgtggcccgatccgcctccgccgcaccggggatatccgtcacatccaccatgaactgatccatacagacgcggcccagaatcggcgccctcctgcctctgatcaggacataacctttaccggaaaggctccttgggtatccatccccatatccggcactaatggtggcaattcgcatcctccgttttgcggtgaaggtccctccgtagcttacgcttgttcccggctcaatatccttgacacaggtcacaaagctcctgatttccatagccggataaagcggcatctccctgttcacctcgtcggaagggtagattccatacacggagattccggctctgaccgcatccagccccatctgcggcagatccataatcgccgcgctgttggcgcaatggcggaccggaatctcaatcccccgttgctttaacgcatcattaaattccatataacgtctgtactgaagctcggtaaaatccttatcggactcatcggcttttgaaaagtgggtaaatagaccttctatcctgattcccggcagcgtgtgaatccgctccacctcccgtacgctggcctcccccggctgaaagccaatccggctcatccccgtatccagcgcaatatgtatctttgccgtcttcccctcctttacggcagtctttgaaagcttctccgccttggaatattcatagagagccggcctgatatcataatccaaaagctccttaaaatagcgctcgtgtgtactgcccagaataagaaccggtttcgtgattttgtgctttctgagtatgattccctcttccacagcagccaccgcatatccgcagacaaaaggatcgatggcttttgccaccggcacggcgccgtgtccgtagccgtcggttttaacaacgcctattattccggtcccggacggcagtcccgctgccatcgtctccatattttttatgatattatcaaggttgatttccgcataaaccctgctgtatggttcttccattgtcgtcctcctgcataattgaatctgcaatctccctggccagaatagaatgatctccttttctctttgccgctctgtctcctgccaggccgtgaagccacacgcccagggacgccgcctcatcttcctggagtcccagggcgatcaggcccgcaatcaggccggtcagaacatccccggaacctgctttcgccatggctccgcatccgctgctgttaataaagacagagccgtccttgcccgcaacaacggaaacagcatctttcaggacgcaggttacgcctttatcttcacaataagcgacagccgcccccggcaaatcctcttttaaagtctccacctcctgccccgtcagcctcgccatctcaccgagatgaggggtcacaatcacattctccgtgaaaaattccgacaggtgaggatattccgccacagtatttaatccgtctgcatctaaaattatgggaacataagccgacaaaagtacatattctgtcaatttcaccacatggcggccccgccccagtcccggtcccagtacaataacactggcccaggcacactcccgctccacaagctcccggaacgcttccggttcctccgcctccatcccttccggataggatgctataattgcctcgggaagcagtgtctggagtatctgcacatttgtttccaccgtcaatattttcaccagacccgcgcctgtcctgtatgcggccagggcgctcagatatgctgcgccgcacattcctccggaaccggccgcaatcagtacttttccgtaagttcctttgtgggaatcctgctttctctgcggaatcctggataaatcagacgtatcatatgtaaaaaaacgcgttccgctgtaaccatcgtaaccgggaaatccgatatcctttacctcgaccctgccgcagtatccctttccggggtatatggcggttcccactttttcatagccgaaggtcactgtcagatccgcctccaccgcagccccaaggatacgtccggtctccgaacagataccggacggaatatcgaccgccacggtgaattcaggcttaagtcccgaaaggaacactaccgcttccctgaactcgccctccagctccctggaaagtcccactccaaacatggcatccaccgccacatcaaaacgccccggcagatatccgccgaaatcctcaattgcaatccccagcttctcgtcgattgatatctgacgttccatttcgcccgtccagcggcttctgtctcccactgtaataatagaaacggaaatcccccttaaatgtaatatacgggcaatcgccgcgccgtccgcgccattgttgcccgtcccgcaaaatacgaggacacgggcgtccaaaaccggctttctcccgcgcctttgatactcctgcatcagctcgtccgccacagccagggcggcccgctccatcagaaccatggacaaaatccctatagtctggatagcatacgcgtcaatttctttcatctgttttccggttaccaggcgtctcatcccacgtccccctctcctactgcataggccgatgcgtacacggccgtattgctgattgatacaaacagttttttgattcccagacgtttggccgtctcctccgcttttccgtataacatgacatagggctttcccagctcatccctcaatacctcgatctctctggggccgaaagtgcgaaagcccgttccgaacactttggcgactgcttcctttacggcaaaattgccggccagccgggctgcattacccccggcctgccggcattcctcctccgtatatacacgcgttaaaaaagcctctttaacacaggcttttctaatgcgttctatctcgattaaatccgttccaacacctactatcatgttctctctctggcgtctcctgcttttccaagggcttcttccctctcccgctctttctggtcctgcatgttgcagacacggtaggaaaggcgcatcagactctcggataaatggacattttccactacgacatcgtcgggaacctgcaaatccgtatgagcaaagttccagatggctttgattccggctttgacaagacgatctgcgatctcaggcgccttagacttcggaatcgtaagagctgcaatctgcacctcgttatccttaatgaactgttccaggtcctcaattcctctaatctccaccccgcggaccaccaggcccaccaggcgcggattcacatcgaacattcccttgattataaagccccggcgttcaaagtttgtgtaatttgcaatggcctgtcccaggtttcccgcaccgatgataatcaggttatgctgcctgtctatcccaagaatcctcgctatctcactatataaatattttacattatatccgtagccctgctgcccgaaccctccgaaattattaagatcctgccgaatctgagaagctgtcactttcatcctgatgctcaaatcattagaagaaatccgctcgacaccctcctccagcaactcccccaaataccggtaatatcttggcagcctggaaattactgcttttgaaatctctttctgctccacggctcttcgtcaccttctctctgaaaaataaattacttttatttattatagcatatgacaaattattgtcaaaggttttttctgaagccttgaaaatcctggctttttatactataattaaacattaacggctgcctctgtttcacttaacagttgccggtctattaccgatgaaacgggaggatatcatgatactgtcttgtaataatatatcaaaagcatttggtaccgactccatactggagcatgtatcatttcatatagaggaacgtgaaaaagcggctatcgtcggaatcaacggcgccggcaagaccacgctttttaaaattatcgccggccagatgggagccgatgagggggatgtcgtcatatcccgcggtaaaacgctgggctatctggcccagcaccaggatatcagcagcgataacacgatttatgatgaactgatggaagtaaaaaaaccgattctcatgatggagcagcagatccgcgaactggaaatccagatgaagcatcgaagcggcgaagccctggaggccctttaccagacttacagcaggctgaatcacgaatttgaactgatgaacgggtatgcatggcagagtgaaatcaccggcgttctaaagggtctcggttttacggaggatgaatttaaaaagccggtaaaagaattatcaggaggccagaaaaccagggtgtccctgggaaagcttcttctctccaaaccggatatcatccttctcgacgagccgaccaaccatcttgatatggagtcgatcgcatggctggaaggttatctgactaattatgccggaaccgtcgtaatcgtggcccacgaccggtattttctggatcgggttgtgacgaagattattgaactggacaacggaaaagccactacttttcagggcaattattccgcctacagtgagaaaaaagcgatgctgcgcgccggtgtcatgaaggcctatttaaaccagcagcaggagatccggcaccaggaagaagtcattacgaagctgcgttcctttaaccgtgaaaaatccatccgaagggcggagagccgtgaaaagctgctctccaaaatagaggttctcgataaaccggtggagttaaacgatgcgatgaatatcacgctggaaccgaatatcctaagcggcaatgatgtcctgtccgtacgcggcctgacgaagcgctttgacggccccgtactctttcagaatgtggattttgacattaagcgcggggaacgcattgccattatcggaaacaacggcacaggaaaaacgactattttaaaaatcatcaacggactggtagaacaggatgccggggaaatcacgctgggcgccagggtccatatcggatactacgatcaggaacaccaggtgcttcatatggataagacattattccaggagattcaggacacttatccgaacatgaataatacccagattcgaaatgtgcttgccgcctttttgtttaccggagatgatgtcttcaaactgatccgggatttaagcggcggcgaacgcggccgcgtatctcttgcaaagctgatgctttccgaggccaactttctgatcctggatgagccgaccaatcacctggacattacgtccaaggaaatactggaaaatgcccttgtcaactatacgggaaccgtactttatgtctcccacgatcgttattttatcaacaagacggccacaagaatactcgatctgaagctgggaaacctgattaattatattggtaattacgactactatctggagaaaaaagagacgatggaacagctctttgctccggcggcagactttgccgcctctgcagccggggcgggtgcatcttctgcttcttccggagccggctcttcttcgatggactggaaacagcagaaagaggaacaggcgcggattcggaaaaaacagaatgccctgaagaaaacggaggaggagatacatgcccttgagaccagggatcaggagatcgacggtctgctctgcctggaagagatcttttccgatgtctcaaaactgatggaactgaatcaggaaaaggattccatcgcatccaggcttgaaacactgtatgagacctgggaagagcttgcagaataacgataacctgctgcggcatcagtcccttccgccgcagcgcgctctccacggagcgcggctgcactgcctggctctcagactttctcccgttttctcacgaccggataattttccaaaatatcatggtaacgaaaacagttttccctgtgatcgttgataattccgcatgcctgtaaatgagaatatacggtaatcgagcccatatatttaaatcccgcctttttaaatccctgctgatttcatccgacagcagattccttgccggaaccttccccttctgatgtcccccctctgtgtttaatatccgttctctttccattattcttccgatgctgttccggcagacctgtaatatccccatgcatcccctcttttgttaaaacgtccgctgctattcccagtatatcacgatatccgcagtccgacagcaggacttgctacgcgaaatctgctctgccgccgcttccggagcctaaaacagttgacagttagagtgcaaggtgttatcttatagttagagtgcaacatgtactcaaaaggaggataagaatgatacagcaggtttctgattttgaattggaactgatgaaaaccatctggggaaacggcggaaccgccctttacgcggaaattgccgaggcgttggaaaagaagggcacgcccgcaacaaaaaatacgatcatttccctgctgtcccggctgattgaaaagggctttctaaagactaacaagattggacggcgcaacagatataccgcccttgtctctgaagccgactaccgcgccgcccagacagaaacatttctggataaaatctatgagggcagcgctaaggatttgatttccacactgattcagaaggaaatgatttcacccgacgattacgagaacctcaaaaagcattgggaagggagctgcctaaaagatgattgaactgttaaagctgttactctccctgtctttttcagggacggtgctgattctgatcctgctgctgagcagaccgctttatcggaaccggttaagcaggcaatggcaatattatatctggcttatcgtcgtggcccggatgctgcttccctttaccccggagccaagcctgacaggaagtctgttccaggcctccggcagcgccgttatgcagcttcgcccggatggaccggagcttttaaacggccggccgatcccgggcaccgacttaacggacgaggatataccttccgacagcagcggtgcagagtcagccaagtccatggaaccgggagcagccgggctgaaaatcgcgttgcagccggccgcacagaatttatggcttatcttcggcttcctctggctgatggccgcggccggcctgctgatacgcaaaataacggtatatcagagctttatcaaatacctgcgggccggacgcatggaagttacggatatggagctgtgggaacggctgggaaccctggccgaacgggcgggtatcaaaagggcggtggggctttatacaaacagccttatttcctcccctcttttaattggatttttccatccctgcatcatgcttccctatgaaaagatggctgattccgactttgaaaataccatccttcacgaattgatgcattacaggcgcagggatatgttttacaaatggctggtacaggtgacaatctgtctccactggtttaatccgcttgtatattggatgggcgcagaaattaacagggcctgtgaattttcctgtgatgaagccgtgatcagtaccttcggcaggcaggcgcagctggcctacggggagactctgctgcgtgcggcggacgccaagggaaaatacagcgactctctcgcctccgtcacgctgagcgagaatgcaacgctgttaaaagaaaggctgaatgccattatgaactataagaaaaaatcgaaaataacaattagcatatcaataatcctgtcagctttgctgttgtgcggatttgcgttaacaggggcttataccgtccgggctgcagataagccccaaagcccggaaaataacgcctcccggcatgacggccgggcgcctaagaatttgcagacaaaaacggcaaaggcagctcatatcattcgaaaggaacgtcctaatctcgagatttccattgatagcaatgccgctgtgaagctggtccccacgtcagcgaaagacgtgacggttgactatgcagataccctgtatgatgtttccgtggaaaatgaaaacggcgactggaaggtagatatcagctatattggcagctattcaaaatacacctccgcggttctgcatatccccgacaccgcctttggggaaatcggcatacacgtagatgaagccaccctgtattttaacagtgtattccggtatggtgaaaccatcaatgcaaaaatcagcgattatgcctcaatcttctatacggttccgtccggctttcagggaactctgaacatgacggcgcctgactgctaccttgaactgtattctgatgacggatataaaaattgcgatgtgactatatcaaacggctccacattcggtgacattgcggatggctttaccaaacgcgggaatcgtttcgtatattccgacggaacgaaagccggagtgatcaatattgatttaggaagcggcggatatgtgtccatcgaagccggcgccagcgaaacagcaaagccggcaaaagaaccggcgccagagcctgaattgtatgccccggattcctccggaaagcttgtcatccccgtctcactccatacgattggtgaaaatgaagctgtctgtatcggtgaaatcccggacattcgtgacgcggtaagctttgaatatgatattacctgtggtgacagccagggaacgatatctgccggtttgcgcagacccggactggacagcgactggtttttccgctgtcaggtgaatataaccgaagacaacagcacgctgcaaacacgttttgataaccattttaattctgccatgggaatttatgatacgtataaaggcagctaccggttctatattcaaaataaaggcggcaccttatcagacatatcagggactgtcaccgtacagtatggcgcggtgacgccggattaaacgataacctgctccgaggtcaccgccatcaggcaaaagccctgcgcaatgacgctattccccgcgcagggctgtaagcaggcggtctatcttctcatccccggcctccgctctcagggcggcctccacaaccggtcccccggtttccctcatgcggcgaagcacttcatccggcagttcaaccgtctcaacaccggattccgagaggacttcggtacatgcttcaagctccctctcatccatctcccttgcataatccaccatctcctgcgccgtctcggttaaaagcttctgttcctcttcactcagagaatcatagaagtccatacccaccagcatacattcaaaataaatcttgtggttggtcaggatcaggtatttttgcaggcggtggatcgagttggatacaatgagcgggagcgtattttcctgtgaattaacgagtccctgctgcagtgcggaaaacacctgatgaatatcataaactctggtctgcgctccgagactctgccaataggccccttctgtcgtattggaagtaaaaatgcgcatctccagcttggaaaaatcctctgcctcatcaatccgctcgttgcccgtaagcacacggtaatgagccggaaacaccgccagaagctttatccccttggcctcacattcctcctccagcatacggcgggcttccccatccttcaaaagtttgtcaatctcttccagggaggcatccgacagagttgacgcccataacatcgctcccatcgtatccgtagccgccggcccaatgcgcatttccaccgtttggttaagaagaggcctgtcactgtcgttgacgtgccccagtgtatcatccggaaatatctccacccggaaccggcctcctgacttctcttccagcgccattttaaaacgccccgctattttctgggtggtactgaatgcggtggctgaatgggtcaggagaatcacgttctctccctgccgttcctcctgctcctgcctctgttcctgctcctgtttctccaataggaggctgaaaagctccgtctccggctgtgccttattgcagccggaggacagcagtaaaacagccgccgccaaaacagccgccgcttttttaagcggacggcgtaaaatatgcacagcctgcttatcatcgttcatcttcacgctgctcctctcccttcatccgggtacggaactgccccggagtctccccctcataccgcttaaatacacggatgaaactctggggggagttaaatcccactctcagtccgatatcccccaccgtctcaccggtctctatcagcagaagctttgcctgctcaagacggtaccggttcaggtagtcgagaaatcccggcggctggtgttcggcaaaaatcctggaaagatagggggccgtaagccccagcttcccgctgacgctttcaagcgacaggctgctgtcgccatagcccgccctgatcagttcttttgcctcctccacccgggcatgtgtttctttatttccctcctgttccccattaccggtacctcctttcaaaaagcggcttaccagctggattcccgggttctccgccctgagcttatcaaactcttccatcctctgctgcaggtccgaccgcgcctgtagccagagtacatttaagtcgaacaagtttccggcaaagtcacttccccctgcatacacatcgaagtttcgctccgccagacggcgccggagtgatttttcaaacctctccagttcccggtaccatgccgcctccgtcatggcctggttcatgcagagtacgattcctttctcagacccgtccatatccacagactgcaaaagcgccgatgccccccagtattcctcactgtaccgtatcatctgaagaccgtatagctccgcatccaccggactgtcgttcccatgctcccggctgcggtaataaagcgccagtacccggtactgtccgtcaaatggaaacggactttcaatctgctccagcgtctccctgaccgccccttcctcccagctgctgccggtcagaaggcccttaaacaagtgttcgctcaatgaggctcccaccgactgcaggatatcccgcagtctctggttctgctccctgtcccctgccatgatgccgcgcagcagctcctgttcggtggcaaaagacgccctgtccgccagagcatatccgggattcttctgggaaatcagagagtcgagaagcgcgcggaaaggccggtaaatccgccaaatcaggtaaaccgccgccagcgccagcagaaccagcgccagcaggccgtatgtagccagagccttaacaagtctgggcgtctccacatccagatgaatcccttccatccgctgtataaaataccatcctgttctgcccgactggtaaaccagaatatatccgccgcccgatcggtaaatctccttgccgtcttcttttctttcctgctccgaaaccagcagcttatctgctcccggatatgcgagcatgtcggaaaataccgggactcctctgctgtcatagacataaatcatgccgcttccggtcgtctgttccgccgccaggcccatttttctataaagttccggcagattcagcttcagaatcactctggccagtgtcttggaatccggatagtccataatcatccatccttccccatccaggcagaaaagcccgctttcaacttcctgcatgtcctgcagccctgaaggctccggctccgcttcatccccgtatccattaccggctccgcgtaaaagctcctgccgggcgaaattatcactgttcaccacacttttgtccgaccccagcaccttttccgaatagggcagataaaggtaggcttccatcacatcttcatcccgatccacaagactcgacagctcctgcaccacattcatcgcctgctgctggagcaggtcctttcccgaaaccatcagacgactgcagtcctgcgcctgtaaaaggctctccatctttgccgtcagggaagccgccgccttgtcggcctccaggctccgttcttttatattcgcaaagcagacatccgactgtttctccagatactgctcttcatagagatttcttaaaaaacagccgaaaaaagtgccgattattatggtaagcgccagaagaaccatcagcgtctggccaaacattcccgaaaagcgaaaattaaaccgtatccgtttcattgattttacccccgctctatcgtaccataaaacagctcttcggacaaggagggcggggtccgttgattgcgcaagttcacttttcgttactgttcacacgcaatgtaatttagttaagcaggtgaggacgccgccggaacggccagcggacggggtggtgggattgttttatgagtctttcgtcccgggggaagattgttgtgagttgggactgcgggcgaagataaagtctgcggagcacactcccgctctgtgaaatgcatcgcgctgctaagctcgtaagggacctcgctaaacccccatgcctctgatgcggcaccaccataaatgaaactgcgagggcggcaggtgattgaaattgctgttgattgagcttatactgacattaacggcaaaaatcggcactaatttgggcctgtagcccgttcgctaaactgattttaggtactctcatttgcaccaccatctgtccagccgcttgcggcagaaggacgtacagtaaaataataatagacagagtaccgtgccgtaaattttattttggaggtaaccatatggataaagtttacgacaaatgttgtggtattgacgtgcacaaaaagctcatcgtcgcctgctttagaaaaggcagcaagcaggagttacggaactttggtgcaacaaccagagagcttcttgaattagctaactggcttcagaacggtggctgtgaaatggtcgcaatggaaagcacagcgtcctattggaagcctctgtataacatcctcgagtcttctgaactaaaggctatggtggtgaatgccagccatatgaaagcagtcccggggcggaaaaccgatacaaaggatgcggaatggattgcggagcttcttcagcacggattattaaaagccagttatatcccggataaacagcagagggagttaagggaactggtccgctaccggaaaagcctcgtgagtgaacgcacccgggaattgaaccgactccaaaagatgctggagggtgccaacataaagctgtccggtactgtatctgacatcaactgcatgagtgcgcgcaacattctggaataccttctcaccggagaattcttcgacgaagcaaagtatgatgaaatgtataaacagaaaatcattgcccacaatctcaaagccagcaaggaacagcttatcgatgatttaaatggtgtcatgaccccattacaacgtcgaatgatgaaagagctgctgtcccatctggatgaactcaatgttcatatcaacaatctggaagatgagattgataactttatgaaaccggaagaaaaaaaaagcgacacaagcaatccaggatgtaactggtatcggaaaaaacagttcccaggccattatttcggtgattggtacagacatgagtcgttttccaacggccggtcatcttgctgcatgggcaggactatgtcccggcaataacgagagtgcccaaaagaggaagaccggaaaaatgcgaaaagggaatgctcttttacgttcaaccctggtagtctgtgcgcattccgctacaagaaataaaaattcgtacttttatgcgcagttcatgagaatcagttcccaccgtggaaaaaaacgggcttatgttgcagttgcccattccatgcttatagccatctatcacatactcaaggatggagttgttttcaaagatctgggtgctgattattacaaccaattcaacaaggaacgtaaaattaatgcgtacctaaagaagttaaaagcgcttgggtgggaggttccggtagttgccgcctgaacctgttagctgagttcaaaataaacgtcaaaaaggttgatgggggaagtctgcgcttttttggcttcccagaagttaaagtttcacagtaatcagcgatggatttcaacggcatccgcagactttatcttcccctccgccccaaggccaggttttcgccgggacgaaagactccgccgagtgtatcagccccgtccgctggcctgcggccgctgattgtctcacgcgttaagtgcgggggcggaccttgtcgcggccactaagagcttgcgtgagcgggaaatacgatatgccttcgatgggtctattataaaaaattgtggaggatttgatatcggcctgccggaaacacgtagtggctcgacagggccctccccatttaaggttagagacaatcagtgcccggagcggaccatgtccggtgtgcgaaaaccttcgcctgagtcttccgtccctggcgaaaccctgaacgggggaaggaggcggaatcaattctgcaggggatatggaagcccatccgtgcttaatgaggtttctcacgaatttagcacggctatgcgcttcgacaagtgcaaacggtccccgtaagaattcattccggacggattcccctcacgacaaccttcaaccagggacggaaaactcagccatccccctcaccacaccggacatggtccgttccggtcgcggctgaactgttacgtcaaatccccggagcgcatgaaatcggcgccccggggacttaaaatggtaaaaacttttttgattaatcggcagacagccatacctgcgaacttatcaggccgtcctgaatgtaaaggtatacgtccggttcgtttttccatccgggcccgtcaccgtcacaacggcgggaccggaggccggtacggtaaccggacagcggctggacgccggggcgccgttgacggtcagcgcggtaatccggtcggacattgccaccggcgtcatagtcaccgtatcctgaagcggggaaatcagcacttcatactcgtaatcaaagggaacgaatttattagaaacagcgtattttagcctgccgtcctccagcagctcattttccatttcctgccccgctttgtatttgaaatcatggcccacgagttctgcatccgaaaaagtgacattgctcagctgtgcatttgtcttataatcaaaatacaggttgctctccacgcggtcgctttcgcccgtattatcaagctcaattcgcgtaaatacattgccgtcgtatttccccttgtattctgccacaacctgttttcccgagatggagaaaccggtccagttaagagtattgaagctgttgccgtcctttgccagaattgccccgtctccgcgcctgtcgtcgctgacgctgtccggcccgtaattaacgagattttgcaggcactgttcccataccatcagataatcgcttccaacgccaatccggttatgtccggtgtacagctcccgtacctgcctgccgtcctttgtataggcagccataagctgctggtgcagcgagagcagcaaatcctggcggacaccctttgccccaaactgatccgctacccagtaacggttgactccataaatatcggaagagaacagcagcccgtgttcacggtcataaatcagaatggatgcgtcttcatggccgggaagctgataaacttcaaacttgcagttgcccagatccagaacatccccctccgacacaaggtgaaccttgtcgcctgtgtatgtgcccgatacagtgtccacgacagtcggatttccgcttgtgtaatccttggcatatgtctctatactccactctccgtcaatcggacctaccctgtcgcagaagtaaacatcaagtccgttgttgtaagcggctgccatcgcccccttatgatccccgtgattgtgtcccagcacaaaaacataaggtttggtcgcaatcttattgacctggtcaatcagagtggttgtcgtattcgtgggcatcaggccgtcgtataggattcccatcttgctgccctcaatataataagcggcagcctgaaagttatcaaaaaaccggtaaacggccgggtaatcctctgagccttcatgcagcttgtctgtggcaaaatcatgccaggccggacggtcaatccgccagataaagcggctgacagggctgtcttccagtccgtccctggtggcatatgcctccacctccacacagaagtaaacattatcataaggaaaatcccagttattattcagtccgaacatcggatccgtggagtatcccggaatataatcaatccactcgccccattcgtcgctcaaggtaacgccgttgccccgatccccgacaaacagccccttcatctgcggatgggagatgttgaaggcccggcagcgccagtgcaccgtggcattctttgtcgatgtaaaccagattggccggcagcgtacgaattttctgtgggaaacaggcatagaccacaccggggacacgattcttctgctgattgcttcaattatgatccgcgcctgcgtatctgttatcccgtctgacggtcccagcgtccggtcggttatcccccgcatgaaattgcgccctgtcagcgtatttaaggcatctctgcattccggacttatttttgccgcatcctcgaagtcagacagataatcttccttaagggcttccaggcaaaacgctctgcacaggattaccgccgcatcctcgcgggtcatgacggacatcggataaaagcagtcgtccggggaggatgccgtcaggatgcccatatcgagcgccgcttccaccggttttacataatcgtttcttcccgtcacgtcaaaatagtttctcacgcgctccgctgtcatgatattgccttcattgtcaatatcggttccgtcgtccatgacgccgttataatgataccagccgaaatagtcggccagacggattagaaaatcgcctctcgtcatcggacggtccacttcgatagagtgtgcgcctgaagtctggcccgtatggaagttgacggaatagacggtcccttcaaaggaccaggtaatctcaacatcatatccccccaccccgtcacgcatgacaatggttccgtcgggatctacggatacaaggtgtttattgcttgacctccatgtcccttccgtcttctcttcgccgtcaatcttggccaccagtttcaccggctggataaattccagcgtataggtctgaccattcatattgatatctccgccctggatataaatgcctccctccgggctgcctgcgcttaccggcgccgttgtctcaccggctccttttgtcgttccctccgttcctgtcgcaacggcggctgccgcacagccgggcaggatcgaagacaggctgattgccgccgctccccaggccatgccttttacgaactggcgcctgcttatcttcccgtccggccttccttcctcaatctctgttttctcccattctttcattcggctttcctcctccaattttattctgtaagtatttttatacgtcccctgcttcttgtccgtttacctgcatttctctcttaagccgtttacggaacaggattctgctcagaagcaggcttatttcaaacaaaaacagcatggggaatgctaccagtatctgtgatgtcacatccggcggcgtaataaacgcagcaagcacgaataccgcaagaatgacatacttcctgtttttcctcagcattgccggattcagcagtccgattctggttaacataatcacaacgaccggcagttcaaaaacgattccgaatgtcaccagggtggtggacacaaagctgatatagctttcaatggataccatcggggaaatcgtctgccctgcattcatcccggcaaaaaacagcagcgtaatcggaagaacaatttcaaaggcaaatgccgcccctattaaaaaaagcagcattccaaaggtcagaatcacaaagcaggactgccgttccctgcgcgtcagccccggcctgataaatccccaaatctgataaagcatcaccgggcatgccagtgacacgccccccgtcagggccagacggacataggacagcaccagctccgtcggggctatgtaaacaaattgaaatccctgcgccttttccatcagacgttccgtcagccaggccgcctggcccagacagatcaggacggctgcaaaaaaacatatgatgcaggctaccagccgttttctgaactcttccagatgggataccagcgacatccggcactcctgcgtttcttttcgaaagccaaagcgttttaatacagcggtacggcttctgcccgtctctttctccaattccatcaccccgcttatcttaaacttctgtctgctcctccgttacctgaatcgtatcgtcctcggctcttttactgcttcttttaaaattcccgatcgtctgccccattgccttgccaagctggggtaatttcttcggcccaaatatcagaattgctatgcccataattattaacagttctgtcgtaccaagtctcattcttttcttcctttctcctcttgagcagtttcctgctatacggcggcttcgttagatatccttataccctccgcctgttcccggttttcacttttcatctgtgaggcggtctcttccgtcatcacggcctgtgtttccgccgtttttttcgccgcctgctccgtccttaccggtcccgcgtcctctttccactctccttcgaaggaatttacatacttcttaaaagagcctaccgcctgtcccgcaagcttccccagctcaggcagtttggacggcccgaagactaccagagccaccaccaggatcaggattaattccgttgtcccaagtttcatttcttacctccttctgacctgtgaacttatttcaattttttgatagggacagcatagcagggaaataagtctttgtatattttcaattttttatataaaaaggggaacatgtgatatttttatccataagatattatttgttcattataagaaaagcgggataagaattgttaaggcagaaaataacccccaaagcagcgcagggagtcgattttctctccgttgaccgctttgggggcagaatgataaatttaataaccagcaggaatttgctctataaataagcttttttaactgcttttaacagaatcttaggcatcttattatacggcgtaacggggcagatctttttgttgacgcccatcagcgtataaactgcgattctggcggctctcacggaatattcttccgtaaataccatgtcctccgggatctccacgaactggcttatcattgcaaagttggtggaaccctccggaactaccgggggacgatcgctcatcttgcgcggctggaactgtgcatcgatatacggcatataacagggaataacattgatgaccgtctccatcagcccggcaatctcttcctccgggatatgaagctggtgcaggtattcaagcagcatctcctcaccggtacagtccttcatggctttcttcacataatcgccttcccggtcggtataaaggccgtagccccagaatatcgtgacatcggacggctggttcgggaagtgaggctgagccgccactacgctgctcaccttccatcctgaatccttaaatgtcataagcgcaccgctgccgggaatattgccggtgaatgcctcgatcttctttaaaatcttgtctccacggcaggtaacggtaaagctcagccagttggactcattctcttttgtaaagaatggctccggattgccgagacggcccggtttctttgctgctatcttactccagagctcgccggatatgggcttttgctgcggtaccggcgcaggggtatggagatcgcccagagtcgcgctgtcagtcatgcaggcgttaatcatgaaacagagatcctccgctcccagctccacagtctcagtctcgccattatgattcaggtggagtctggtaaccgtgatatcgtctccctctgcaaaatctatatcctctaccgtacaattctccttaaataccacgccctcttttctcaggaactcttctatcgggcggatcacgctgtcgtactggttcagcgggcttctcgtgacgccttccagtgtctcaattcggctgaattcaaaaatcattctgttcatataccggcggaattcaaatacgctgctccaggtctggaatgcgaatgtggtctgccacatatgccagaaattcgttgtaaagaaatgaggcatgtccttaaaccactcctggatcgtcacatcatccagttccttctcatcggtacgcagaagcttcaggattctcattctctcagcctgggtaaagcccatgctgcggacatccagaatattgccgtccctgtcgaccagacgtgctttggcgcaggtgggatgcgcatggtcgaaattcagaatttcctctgttacgcttctgttcggctgtgttaaggaaggaatcgttctgaacagctcccagaagttttcgtatgtctcttcgttcagcatacggccgccgcggcatacgaaaccgccttccggcgttccgattccatcattgctgccgcccagaatatgcattccctcatagaccgtaatctggctgccggggaatttgcagtcccttatcagataagcggctccggccaggctggccagaccgccgccgataaaatgagccgtccgtccggtatagtcgcggcgcttcatcacagcttcctctaccgcctctttttggatctcatctttctttttcttcgtgtcgtaaaccttttttgcagctacgcctgctgcagcagctgctgctcctgtcgccaggatgcgccccaattttttctttcccattggatagaccttctttctctcaaacactcttttggccaaacagatacttaagaaatttttccctgaattgcccgtttctaaccctcccggaactgaatttcctgtaaatttgcacgttcttgaaatcggatatggcatcctgcagggatttgcggtacttgtctgccaaaaacagattacaccatacattataccatatccgattctaaaagtcactatatgtagtttttgtatctacatctgtttttctgatttatctgattgaataacggttccggcggcatagaatgttactgcatctgatcattccatattttcctgatatagtctgagaagcttcctcatctcctccgcaaccggctttgtgtcaaaagaatactctctctttgtcgttttctcccgcggcatgtggttctgcatatcaaaatctcctacggaaaaaccgttggcatacaagaactcctccccgtcaaactccagattatagaccctgtcgttatatggcttcatatagatataccggagttcctcctcaccgtccttcgtaagaaagagatccgcgccgttcaaatcaaccgcgcgcaccgtacagatgctgccgtcccttctcacccgaaccggatggccttccgtcatcagtatctccttattgcccattgtctttacgtataccatctccgcttccattccgctgataatatttgtaacccgaatcggcattccgtccatattctgtgccagatcgcctatcctgatatcttctatcgcccgttctgaaccgtcggccataaggatccttgtatcttttccaagacagccaaacttgatatggatctttttcaccttttcattcgccggatcttccgactccgtatccagatcgctggagacgacaatcgtcacctgcccctcttcgtatttcatggagccatgcttacatttgatcggcagaatacagctaaaatcagcgagcatcactgcggaaacaatcttcattttcatcaggtgttcccagtccgacggaaattcataggtaatcttattcttttctttttcattataggtgacaattatgttttttgccaggtcatctttattaaaaacaactgttccgttatccaggctccagattttcatctcaaaatctttgaagtaaattcctttaatcttatctgcctcatctactataaattcaaattcatcgtttaactcgattgtgatcttagccggaatatgaatctttacatatacgtcttggccaagcgccagccgcactcctgtatacttgggatagtcagccgtctctccccggtctgcatccctgtcgtacaaaagctctgtgtatttatgtgacttatcctttggcttcggtgattccacagtcacggccttcacaatgtattttgttccctcaactttcagaatattgctgtacacttttgttgactgcgcacagagttctccctgagcattgacctctgcacagaaaaactccgcctgtgtctgcagttctctgtcgtcggattgaatcagcctgcccgcatttactttcatggtattctcaatatccgtgatattttcatcaaagacagccatgctctccagaatctgtccgtttgtgatatccatgaattttcccattaaatcaacaccgagcatctccctcgtatatctgccagttacattcgtagatacgaccgtgttcggatcatacgcaatatcggatacctccatacagtccctggggcctaccaggtacccgtccagcctctcctgctgcccggcgccgctctttctccacagcgcgtcgtaaagcagaggacactcccgcttaaatacctcttctcctccatactggctgaaaaacacgtctctgtgatcttctcttgacagatcataggagagagaacggccgttctctttcagctcgcatacaaatttttccctcagctgcattaaatttctttccatgaaacttcctcccttatctttcatgatattatgttacaggtcagccttcggctaaaccgtgatgttatatttcttatgtataagaccagacgctgcgcccatcttcctccgggcttatcaaccagagcttttctttaaagattcccacgcaggcaggcctctcctccgtccatgacagcttttccggcagaacggattcttttgcaaaaccgccgctgccgcgcttggcatagataccgtcccgcattatgagaaacaggccgtccttcctggacagaagccagaaatattccttttctttcggattctccacttcgtatttccaagtccagtctatcccgttgtccgtgccaaacagaagaatctttttttcagtgccgactgccgcccacaccgcatcctcccactccgccagcttgaccagatacgcgtcatccgtctctaacactgccataagctgccatctgccatccgggaagtcccctttcctgtacagctcggctttatggctgctgtcaggcagaacgcagacccacacgctgtcaccggctctgagtaccgctgtctgtccatccagcaaaaatgggtacccccattgactgatacgtgcctccacggcctgccagcagaccaggacgcccgttcccatcagcgtgtccgtgccaaacagccacaggctgtccttatagcctgccgtcccatacgcgcgccaggctccggcctgatccgacaaaactttaaattcggcgccgtcctttgcctcgtacaaaactgaatcggaaaacgcatacagcttttcaccgcaggagagaagttcccggttccaggaggaagctgtatctttttccgagagaagcagctctttgcaatgctgttcttctttccactgtccctcgctcacgttgatacagacgcaggcgctcgcatgctgtcccagtttgttggagactttcagcaggaaacggtccgaacttcgaaggctcacctctctgcttcccttttcctctacctgtccaaatcctgtaagcatacattcctgcgaattcctcacctcccagcgaagagtcgtcgtttttcccttcccaatcagcgagtcatccgcctgaaacatgataatctcaagcggctcctgcttatgcaggggaagcgtatattcgcagtcctcatatcccggaacgttctggatataaatctttgccacggtcaggccggcaatcgcatcagagataagattttccaacaggaaagaaatgctgtactttttcttaagcagtaccgtcccgctgggaatcaggataaaatatccatccggcataagtttgatatcccactgatgctcccccattacccagctcgggacgatcgcgctccccagctcctccgaacagaggcagccctccccggttccccagtaaaaccgcacatatatcctggagaggccactccactccggccggctctctgtctcatgaatcccgggcagttcatcctctttcgtcagcttaaactgatttttaaagctgatatcatcatcctccgaggcattcatcacatacagttccagttcatttttatacggccttttaaaatctgtggtgatgtacaccatattggcgggaaaccaatcaaaaataagattttccctcatctaagcctccctcctgccgcatgggcaagacttcctttactccctgctcatgaaaccgtcttccaagctgtttttctcctgatgcatctccgctgccacaggcggttcaccgatctcccgccgttccaaagcaccgttctttctacagtaccagaaaaagggttctttccctcctatctgcggaatccccgcccgttccggtcccgccaggatgggatagattggcaggcgtaggttaatgtgctccagcgcatccctgaaaaagacaggatccggctttttctcatagaccggaagaatccccgtcctgatgtggatactccctgtcacatccaaaagaaaggtgagcggcactttttcatgctgcactttgagttccaggtcactgttgcaggaaaaatagggatccttcatcgtctttgcaccatacgcagggtaaaatgtccggtaggtacttcccgtctcctcccctctgtaataaccgatcagcccgtccgacgcatatctcacatctccaatccttgcctcataagtattttcttcaaatccgtacgtatttctctttccaaaatccttcagtgccttagaatagggcagaagcccctgccacctgagggaaagtccgccccgcagcatggcaagcggtctccctgtcagcatggaaagctcctgatcttcatcgccgcctgcggatatccgctctgaaagtctttcatcaatcagcttcaaaaatgcccggaacacgccgtccccgctctccgtcattccgtggataaaatgacgcatgtgtccggaaagcgttcttttcttcccatcctccagcgcggtaaaaccggcacgcgtgcttccatccggaagccagacaagatacagatttccctcatacccgcccgcttcgtcataaatactgatccggctgttcaggaaatccggcatgaggtaaccgcagacaggggaaaattccggcgctttttcctcccagtcaaggcaaaggctgccgggtccggaaagcctcggcggcaacactccatattccccgccgccttccggccttatggattccgctaccgcaatatcattcagataactgtcaagctccgctgtctgcccgaaggtgtctatcatcctcagtgcgtccgggcggatgaatccggctctgacgggaagaaattccatgttgacattcaatgaaagctccccgtaatctccgacttgagcccgcacagcatcggcaaagctgacggctgtctttgtcaccccgaatatagggaaggataccgcctgatccttgcagagaaatgcctcgttcaacccgctcatgttctgggaaagaaccggaagctcctttgctttcccggcaatggcgctcaactgccggtacagcgtctcattataccggaatgtctctatatggcgggttatggcatcgctcagtccctgggccgcgtgaggggttataatcatgcgccctctgtactgtttcaattcccctgcctctcccgcgcctttgtaagaataatcgatatcgccgagtctccagtcttccatcgtgttatccgggtcagcctgcgtccttgagggcaggaaatggagccgccagtctaaaaacagcggattccacggcggatgaaaacaggtgactgagacggcggacggcagcgtacctgtatattctttccctgagcctccctccgccagatagaggaacgcagtctcatcatataattgataagcagcctgagggacgtccgctctctgtgtgaattcatcacaaaacggctttatcgttttgctgtcccaggatattttaccgcctccctccataaaggagacggaggtgatcacctcccggtccctgcgcacagacaaaagcccgtcctcccggaacctgacgtctgttccaaacagttttgtcctgctgacgccctctcccgcagccaaaatcacaggaacttcgggaaagaaaaattgctcctgcgccattttaaactccggtgtgaaggactgatccgccagaagcgacttaaggttctcctgctgcctttgcctctttgcctcctttcccaaccattcctgtctgtaagtttcaatttctccgagaatccgttttccctcttctaacaattcctcctgcgacagaggctgtttgataaaaggaggcggcggataactgtacagcagcatataggtgtaccagacatcatacagctctgttttcttcgattccacgatatcagagagtgactccgcctctttttgaagcttatttaaggcagaaactgctgccctgaccggttcttcagggctgtttttattgccgtcggccggcctcagaagccattctccgctttttcccgactcgccaaaccggccccggtgaagccgatcctcggttttgaggattccgtctatctcccccagttcccccaggagatcagactggagaatattcaaaatccgttccagctcatacatatctctgccgttttgacgggatatctccttcgccgccagagcggacagcgcctcggccgaggaatagccaagtgccacgcggaccgctccctccggtccgccggtcggataatcagcatcctccccctcccactttacgtggaacaccgcgccgtgcagcagcagatccgaatcattttcttccctccatcccccgcccggtagtgtcaagtctgacactccgttttttattaaaaaccttgtattttcagggattacaccacttttgaaaataaaaaagcaatgacctccccttttctggtataatgagttcaccacaaaccatcacctaaaaaggataaatcattgcttatggataacattatactctatttactcactataattcaagaacaatacaaaactatctgctggctcctgaactttatctgcaaatatattccactcaagcagtgggcctttgatggttcccactcccctaaataccagaagtttactaccgaccccctcccgctcctcaagccgttcatcaaacaggactggcagtttctccttgaatactatctctggaagtacggcaaatccgtcagacccgttcagcgccgcaatggtaaatccatccctgaagataccttctgtcctctttgtggggcacctcaccactatctctacgataataatggcggcaatgggcagttccaatgcaaagtctgtgggcagacctttgtcaccggcgaggttgtcacatcgcctctccgctttgtatgcccttactgcggccactccctcgtccctaataaggaccggaagtttttccgcatccataaatgcgtcaaccccaggtgctccttctaccttcacaacctctccagggttgataaggaccatctgcatgaggattacggtaaaaacaagtataagctgcactacctctaccgggaattcacggtggatttcttccgcatggacttagactccctgcctgagaattcctcctccctgaagttttccaaacataacgctcatatcatgtccctgtgcctcaccatgcatgtgaacctccagctttccctccgtaaaacggctcaggctctgtatgacctttacggaatcaggatctcacatcagcaggtcgccaactatgccagaacggccgccattgtcattaaaccctttgttgaccactatgaatatccaaagtcctccgtctttacggcagatgagacttatatcaaagtccggggcatcaaaggctacatctggttcatcatggatgccgcttcccgctccatcctcggctaccaggtttcagacaaccgctctgtcgggccatgcatcctcgccatgcgcatggctttccggggcataaaaagactccccgagaagtttcggttcattgccgacggctatagtgcttatcctctggccgcccagcagttcgtaagggagttgggagacagcttccagtttgacattacccaggtaatcggactcacaaacaatgatgcggtctctaaggagttccgcccctacaagcagatgatcgaacggcttaaccgcacgtttaaatccacttaccgggtcagctgcggttacgacaattacaatggcgccaactataacgtggcgctctgggtcgcctactacaactttctccgtccccataagcacaaccactatcgggtgctcaatccagtcggtatgctggagggggctgacaacatgcccgggaagtggcagctcctgattctgctcggtcagcagaccatcctccagctgaaggaacagcaggctgccggttaaatctgttcttagattccgggccagaggtaaaaatgcagccatcccgaagggacctgcccttgatggcacgccaaaacaatgctatcatgctgtgacgcagacggtgaaatcttatctgttcctgagttcttcgccgtcggtaagacgttcagagcattgttttggtgtgccgtcaagggtggcggacactgccagtttctaaatatatctgtaatttacaaggttcatttacgccgggttccccggccatcggttttcataaatcacttgacactaccccccgcccaggaagaatcccatctctctcagtttttcttcgtattctgtcccggtaagcccatataaaggagaatttttccgatccgcgtaccagccggccaccgtgtagatcagctctccctccttcacgtccttcagatcgtcgtgaaatccgaacacgcttctgcaggtctggtagcaggcggcaaaatacggcgtccccgcccccagaaccgtcagttttgaaagatactctcccggcggcgccgtattctcatatggataggttcttcccagatagcggcataaattctctttgtccgaaaattccggtatggagatactccccacattatccctgccaacgtagctgctctccagaatccatgacttatgcgtgattaccggcttatcgggcgttgattttacgatggtgagccttgtcacaaggtaacggtccggcactgcgggatagtcaaagccattttccgtctccatgccctgggtcagcccgtccggcagaataaaatgcagatggacgccggccccgggcgcggccctttttttgaatggctgcggctctatcacgccgccgaggagtgagacaccgttcagcagttcataatttaccgctatatccgcatactctctggaattcccgaaccggtttacgatgagggcctccactgtcataggcaccaatatcatgtcttatcctcctcccggcaaaacttgacctccgatgcgctgcaaagcatctccagagcaaattctgcggacgtaaattcgttatgatcggtatgaagtttctccataaacatcgaggcgagagataaaacatcaaccatcctgcccgctctcaccggtacagggtacagctcatccgataatttgtcgcccggttttttatctccctccgccttgatccgcctgatataaattcttccatccacggtacgcgttccgaaatgaagtccctccgaaggctccgtcacaatcacctcgtttacgctcccgtcaaaaatccctatcataacggtgtcagacagcgcttccagcctgagaagctcacgctcccggctcccttcccgcccctttacctccattcctttataagctccaacgaggcgtgagcggatcaaaaatcccataaaatccgtttccggctgaagattttccttagccttgcacttgataagatggttttcatgcatccgctgccttctgggccggcgaaggcggttcgctgctttctcacgaaaaagtccggcgaaagccccggaaagttcccgttccgcagcaatgcctcctcctatactcagagcgccctccaccatcgcctcaatccaattttgatccagatgaaaaaaacgtacggattccatggggaggaatcgctcgtcaggaacgagatattgaaacggaacatcatataaaagccatgtctttgcaatccaatcaagaacactgtccggaagctgaccggctgtcgttgcctcaaacgggaactttctgtcatttctgtctgtatccatccaggatttcatgattctcctcctcgtataataagtttgtaagcaagaaaaaccgcttacagacttattcttttttgggtataaatggtaaggatatctaagaggtactcccctcatcccgattcccatctatacagttgatagttacatttcaatataggtagatcctgtggtatgatatcaggtagagtctgatgtccgaaggcactgcttctcctcctttcagccggcttcgtccgagactgctttgaaagcattcagcctggcacatacggcacattccgctgacacagaattttcatccccagccgttagccccagcaaaaaaggctgactgggtgcatgctcattgcgcgagggttcggtcaccgtatgcggcacaggataaaccttttgcttcaggcttcacaaatccccatcggaatggaggtgatatcatgttaaagctcaactatatgtccaccttgtttgtaggtattgatgtaagctcaaagaccaatgccgtctatgccatggactttgaggaaaacaaatacatctcatcgtcgtttggcaataaccagccaggcgccgatcagcttgtaaatatgattgccgaatgcatgcagaagcataaaaacctggatacggttcttatcgtgctggaatctacttctgtatacagcgtgcatatttcaaacttcctgtcggccagcgaggttctcatgccctacaggccttacgtattctgtgtaaacccaaaggccacttcgaattaccgaaagtcctatatcggaatggaaaagaccgatcccacagatgcatatctcatcgcagactttggcagggtaggccgtacgaaaaaactggagccatggcgcggcgggcagttcatatccctgaaacgccttacaaggcaccgtatgcacctttctgagtgcatcaccagggagaagacttatatggtttcgaatctttatctgaagttcagtgaacttcagctccttgaaggtgatgacaagccttttggcagtctctatggtgccacgtcctcagctgtcctgacggaatttttgtctccgcaggagattatcgatatgccggaagaggagctgcttaccttccttgcggggaagagcaggaaccgcatctctgacctatcaaaaacttcggaactcctgcgcaaggcagccagggattcctaccggttagacaagtgcatgtatgaaccactgagcatatcactggcaagctcgtttaactgcatccacgcctatcagaaagaaatcaagctgatcgagcaggcgattgagaaatgcatcaacggaatgaaccctaacgccctgctcatccttcaatccatacctggaataggtccgatatgggcatccggaattctatcagaaataggcgatataaccgtgttccattcatccgatgcccttgccaaatatgccggcctttactggcctaagggtgattccggagatttcacttctgaggacaacaaaatgtcgaaagccggaaatccctatcttcgctgctatcttggcgaagcggcaaacagcgtcaggaagcacatccctgaatatgctgatttctatgccagaaaatatgctgaggtaaccaaacatcagcacaaaagagcactcgcgcttacatctcgtaaattagtacgactcgtttttggattgctggtcaaaaaccaactgtacaccggcgaaaagctggacaccgaatataatattgagtcgaactgacattcggttatacgtaaaatataccgaaggtctgttaaagttacccttttttctgaaaaacatatcaaaatcttcttcaaaaagttcttgacatatcaccagaatgcttttacagggccgaataccgacgcggcgtccccgccgccaaccagccattttccgagatcaccggccagatattccataaagcctgttctgatgctgccctgatactccctgtcctctttccctgccgaaacagaaaatgcctcaaaatgtttcttaaggatttgaacttcccccgcccttctgcgctcacaaaaaaccagttttctccaccggcagagatctcctgccgccgctttgctgttcaacatcataagacggccgagctgccaggccgcggcatacttcatatcaaacagctgtcataaaggatccggccgtccgctccggcgttttgcccctgaagggagctgtccggcttctccggagtaagcggtccccggtaccaggacgcggtctgttcccccgtcctgacaaagtgattcaaaacagtatatcctttttgcagccgttccacagcatgggccggaccgcctggcagcggctccccgctctggtacaggctgagcctccctgaatccagtttttccgtcagggtgcggaaactctcctccgatgattttctcgaggaaaattcccagtgatacagagataccatctgaatccaatcctcattcttccaggcctcctcccgtcctccgggaaggtaaccggaaaatccctccaatgaaaccagatgggcggtgcagcgcaccgtcctgtccaccgcctggggaaaacggctgcacacaataacgccaaaatatccgggatgtgcgattatgttatccggcctttcatgcagatccgtaatccggacatgcgccagccagggcagctccgcttccatcggaactgctttcttgaacagttccggactcatccggatcacactgcatgtattttcccagtcttcgccgggctgtaatcctgttccggccaagggaaaaaagcatttttcttctttgttcaaaagcttttgcagagtgacttccgacagctttggttcctcatcctcatcaaacagcagcagcgcaatccatggagtttgattcttcaccggtgtattttctctaagcgccgggccgcctccgatccgccggtcccacggatacgcttatttataaaaaatgatgtgaggcagtgtaaccccataatcggacaccataccggccggtggataagcttcgtatatctccccctgttccaattcaaaccgcttctctcccgcaaaaaagcggaactctgctccgggtatctcctccgccacagggcttgtcacattctgatgcactttaacccgatattctccggcatccgccgcaggcggcgaggatgccataaactgcatttctccatactctttcatcattcttctccataaacggctatatccctgcagaatgtaatctgttccgtgaacagattctccgcattttcagccaggctgccgatccggccgtcaccctccagttccatccccctgtcattcagccacagcagcagctttcttctgtcatccactgcggcctccgccatggcggtcttcgaaaattcctggtttgacagctctttgtcttcctcctctttcacccggtaaaccgggcggcagaaacaccagtcttttaaaacggcttcctcctccgccattcggtcaagatccaccggactgtcggggaacacatagacttccgtctccttcggcgttaacagaacgccggtcagagcgtgttctatcatagaaccgtcaccagacaattccttcccccacagcgcggccggaatattctcatactgctcctcaaccagaaaggtatcatgtttcaccggcttccatactccagctctatcctgctttttcaccgtcacaaccgtctcgcaggacagcgggactccgcccatgggcagaataaacaggctctcgtttcctccgcggcatggaggtttgctgtttatatgaaatgcggcattcggcacctgcgtatggattgacagcttaaagccctctccgcgcacaaggctgaccggcatcttctcactgtctttcgtttcctcgataaggccgtcactcaccgtgaccgtggcataatttttacctgatgcgcagtccggcgaaccggttttaccctgttttgcgtcaccgggaacgcactgttccagaaactcttcaaaggtcagatattttataccgctgttcccgctgccaaactttatcgtaaaagagatgatccaccacttcaccttcattttcccggtaaactcaggcccccaaagactcagcgccgccgatagttcaagcgtaaatgtatgatggacaaacaggcagtccacccggtaggatgcgccgattccagccgctatccctatctgatagtagaacggcttccaatacatgagaaagtcggccctggcataaaaccatgcgctcagatttccattggcatatctggcgtcaattcctcctccggccatgatgcaggacggcgtcagcgcaaaatacagcccgcctgaaaaactcagattccgatttaccatccaggaaaagccaaggcgttccacttccggataatgggaaggcctctcaaagccgttatgatatccgccgagcgtcagcacgaaatcccccttgtgaactcccccgtaccagacataaaaagcaaatccccctgtcaggtggcattccggggaaaacaggtaagattcattagtcagcgccgctcttaaggagaaaatcccttcctccgggcagattacggcttttaaggataactccgcctttgcaatcgtgccgagcgtcatctgtcccaatcccagcagggcgatttccagatgatttcctactgatacggttaaaatggcaaatgattttaccatctcaaaggacgtaaagcggattcccgcggccagccacatctcctccccggagattttcatgtaccgctcctttagagtgcggatcagttccgcctcgtttccttcctcataaaccatacgaatcagcggaaactccgcgacctgcccgatgtcggggagaaggagctccctctgatacccaaacccggccgccacgccggtcacgtagaatgcaggcggtccacccagcatctttctgagcactccgtaggcgaacacggaagggctgccttctgtctctgtgtaagagccgatgacagtcaggcttaaatcacctgcccgcagaagcaggctaccgtcaaattcaagcggcctgtccgaagttttcatgaatgaaccgcccagagaaaaggaggaggtgttaaacgacagctccatccctttaagagtaaaggaaagatttctgaaatccgaaaggtccattgaaaatccaagtcccagaaaccggattgccatcattttgcagcacacagcggtatccaccataaaagacagccggtctttttcatatccgattccgatgcgcacaagctctagcgggccgagcgtcaagtccgccttcagccagcatatggtgtctgcgtcttcataggcgacttgattaactttttcatccgctgtttcccacagcccctcacaggctgactcagtcccggccggtttgcaaaggtgcagggtaaagggaagctgccgcataggcgcgtttaagctgccgcacagcgtcactcccgttccggtctgatacaaaaggctgatgccgtttaggaagagcccgtcaagagcatgcatgctctcccctatgacaggcagtgagctcaggcgtatctccggagccagactgaccccggcccggaatgttaccggccgctctctgccgtccgcctccagaaagagctcattgtcatttctaaaccaggcgcggacggcaaactgattctgtcccatatcatagtccaccgatacagtatagaccggaacgccaatcgctttcaggatatccggggcctctcccacggacagaagattccacagggacatgagtccaaattctttcccattgtaaaatacgccggagaaccgccaggaattaccctccccgtattttagagcagagaggtacaaatcctcttcttcatagcttaattttccccgtatctgtaacgactccccgcctccttttcctccaactgcgtaaccgtcaaaatcaaacccaatctcagacagtgtcagactttcgattcccatcagccggaatgtcccggtcatggtaacggaaaactccagccggtcaagcggccagaggccggcaggcagaagaagcagcagacgttccagcttaaggccgccaagagccagtatttcgtccggcaggagctcgtccagcttaaggccgaataagcctccgaaatcctcaagagacggaagctctgccggaagtttatctgcgctgatacacagacgccctccgctgtacgccagtaagaatgccagctcctttgttccgataaaaacgctccccaggattccaaaggagccgtaagggccgcggtcacaaatatgcaggcccggatgtccgattttaaagttcccaaacagcgtccaggttccttccgccgtcagagacgcctccaggcggctcgggtcttcttttgactccgtctcatagactccgttcatggacgccgacggaagcgccggaagcatctcagacggaaatgtctgccccgacagggccagaagcatagccgcagctttgccgaaagacggcagactgccgcctgacggctctgccgcagctttccagcgcccggccttctcatcatagacggttacggccggaaaagtcacatcatattccccctcaggcagcgcttccgactgcatccggacatcaccttctatctcaccggaaaatggcatctgcacatacttctccagttcctcaactgatgagagctcacactcctccccattgatataaaatatcgtatgccacctgttttctgcgaattcccactgatattccaaacgataccgatccatcccgcatctcactctctgaaagcctttgcttttacagcaatttatgtatgcacttttaatttttcattgcaataaacattcatttcttatatgatactatatatgtacagtaatattcaatatatatccatttatttcggaatttttatgtaacagttcgctactgttcacagggtaatgttccgcgaggtgttttcgtgtgtatttcacacgaaaatcccgagttatacggcgcgacgtgatgaaaagtgaacttttcaccacaatcaacggctctttttgccgtttctgggcatcgcgaagcgtgttatggaactggtagatttttatatcggaggagtctttatgcatttttattatttcacttttgacagcgccgagccggccgtcagaatgaatctggccggtcaggaatatggcattgaggcggcgcttggggaacttggatttgaaccggcgctctcttctctatggattggaaggaaacattttcatttcctgagtgagatagatttatcagaacatgatatcaaaaagctgaatctgagactgtatcaaaaccaggcggttcagaccctctgcgaaaggtttgggaaaacagaggactcggactcccctcttccttttcggatacagactgaattttcatggaacgccgttatagaaaattttgatacgggagatccgtccgtcacttacgccgaaatgcagctgttcaattttgcagatgtggaaccgctgtttgatgatttctgctattacgacgaaatagaggacggcccctttaaaaaagcatttcatgccttccacacctgcggaatctcaagcagggtgttccagcttgccaaactcgaatatcttgccacccttccctgtacatgcggactctgcgcattcactgataattcctggcatttttatcagatcggagtcttctaccaaatcgacgtatcggacgatccaaatcgcttcaaccgccctgtatctcttggctttgaacaatattcccccgtcttgaatgccgataatatctacgcttttctggcttatgcaattgtaaacggaagctgccttctccatatgtctcccgtcccgtacccggccggtttactgttttctccggttgagattacagggcaggctacaggggaagagcgccccctctccgccccggccccattcaatgcaggaacaaccttcgatgaggcctttatctacaatgtgggtcaggcccttttagtaggcctgtttgatcagggactgctgcggggatttttcgattttggccttcctgacggatttaataaacggcattttctggctccgggctgtaatgccgttgccgccgccatacaatggctgatcgcaaataatcctacctcctcctccattatcctgtcacactggcatttggatcatacgaacatggcggttcaggtcccagcctgctataacctgaactggtatgccccatccgggtatagcagccccagtgcaatgaaaatcaatcattttattgccgcgaacggcggcacgctgaccttgtacacagccgtctctgccatgccaaactttggcattaacctttccatccacaaaatcactactgttggctctacccacccgcatcacaacggtatttttgccgaacttgtttttgcaaacgggaataaaatgatgctggcgggagactgcctcctttccgccgtctcagcagcagcaaccgcagctccttatcattatatgcaggcttcccatcacggcggcgtctactatagaactacggttgccagaaatccggcggatatacctgcctgcttgccgcctccggcaggttttgcacttgtctattactcctactcattccccaacaggcatcatcatccgtcctatgtagcggattacatcgggcagggatgggttaacagacgggatacccacggcgcccccggactccctgcgccggttccccctgcgccgccgcttcccgccgtgcttgtgaacggggtcagaggatattccattacataaaaatttatgcccggccctcttctttctttgatttcctccctgtcccgaccgccatggcgaggacaggagaagtaaaaacagccggagctttgaagaatatgcatctcttcaaaactccggctgcttttactgcctcattgagggcggtaacctgtgcgcagagcgtgcagattatcgttgtttctcctatgccgccccgcctgccggtccaatctgccctcccaggctttcatcggaggccggtccgtttccgcccgaaatgatgccggggtcgtcgtccatctcaataaaatcatcctcatccggcttctgtccctccgtactgatccccagcgtctcctccatataccggtacagggaggggctgagctttttcatatcggctctcacctccggcttgcagtaattctcaaacaggtttccgaacagcatggaagaatcgttgtcaaaataagatggaagaggctgagctatcccactatccatcaggtactgctggtagtcggccataaaggcattttcctctttatcatttccggttgccgaggccacatactcgccaaaggccagggccagcgactccggttttgtgaatttcagttttttgtaatgggtatccgtcttatgatatacataataaatcccctgctcggtccggggggcggaataatatttcttatccgtgaaaaacataagctcccagcctgactcattaaatttgcggatccattctcttgggattccttccatggcctccgtgatccccttcttttcctcagccgtgggcctccttttcccctgaatcgtaatatcatactgcttatcccgcagtccgttttcatcataataattcatttccacatactgattggccgccatctggccgttttcgtaaaaataatatttatgcgcatcaaccatgcggtacccacggttgtacatcttatatttggaatcaaaccaataccaggcgcctccggcatggagccacccctttgtcagctccccatcctccgccgcatggtaccagcattcatcatcctcatcataggcccagccgacagccatggccccgtttcctccgaaatagtaggttttggatccgattcgcttaacacctgtctgcatatatccgctgctgctgaaataataccagcagccgccgtaatacaaccagctctttttgaggcaggttccgtcggtgagccggtactgccagtcttccccgtcgccttcccactccccgtcaacagaagggtccggctctcccgaagtctccgccgcctgtccgtctatttccgcctgctgctctgcgtccgccgaagccgtctcctgcacaggaagtgtttcctggccaaacaccgtaccggacgacaggatcatcatcaggcagacagaaaaaaatagaagcccatatttattcaaaacacagcgcccctttcctgtatgttcatctaattgcttgtaacagttacgacagcatgaactgttactgctgtttctattattttatcgcatggcaggtgaaaagtatagaaaaaaattcttacatcatttataataatattacagttttctgtccacactccgcaaaaaacggcgcagagaattgatcgatttttatgaaagcgaggttttcccatgagacataaacgactgctggccatggctgccgccatcctgctcctgcttctttacgcatccacaatcgtcttcgccctgatggacagccctctgtcccagagccttttaatggcttccctcttctgcacgatcgtggttccgtccattctgtatggatactatgtcataataaaatatagaaaggacaagaaataaccgttgataaatattttcaatacaaatatcccggcgaaaacccgaatcgaatcataagcagtaacacagcaagacttcaaaggaatattttattggaatttgaacataaaaagcaggtacgagtgctctgcccccctgtcaagtagacaggggacagagcactcgtacctgcttttcaatcagcgttcaaaagaaacagttcctgcgtccctttgcagcctgctattttctcatgataatctcatcccgtcccggtccattggaaaccatcgtgatcggaacgcctatttccttctcaatttcttcaatataagcgcggcactccgccggaagctcattgtaattgcggataccgcggatatcgcatttccagcccggcatcttcttgtagaccggttttgctttttccagcttacatgtcacagggaaatcttttacaatctcgccgtctatctcatatccggtacagattgtaagctcgtccagatagcccagtacgtctaataccgtaagcactgcctctgtcgttccctggatacggcagccatatctgctggcgacggcatcaaaccagcccacgcgtctcggacggcctgttgtcgcgccgaattcccccttatcgccgccgcggcgcctcaattcgtccgcttcctctccaaaaagctcactcacgaatgcgccttggccgactgcgctggaatatgcctttaccacagtggtaatattcttaatttcatagggagggatacccgctccaatggcgccgtaggccgccaatgtggaggaggaagtcaccatcggataaattccgtgatccggatctttcaaagaaccaagctggccttccagaagaatattctttccttccttaagcgcttcgtaaagataagcggatacatcgcagacatacggctccaccatctctttatatttcaacatctctgcgaacagctcttccggatccaaaagaggcttatgataaagatgctcaagaagaacattctttgtctcacataccctgctgattttttccctcagactgtcggcgtcgaacagctcgctgacctgaaaaccaatttttgcatatttatctgaatagaacggcgcaatacccgacttggtggaaccaaaggactttccgccaaggcgttcttcctcgtacgcatcgaactgaacatggtaaggcatcaaaatctgggccctgtcagataccagaatcctgggcttcggaaccccttttgaaatcagatcattaatttcattaataagataagggatatttaacgcgacaccgttaccgatgatactggtcgtatgatcataaaacacccccgacggaagcagatgaagggcaaaacggccgtagttgttaattatggtatgaccggcgttgcttcctccctgaaaccggataataatgtccgactcttttgccagcatatccgtaattttgccttttccttcgtctccccagtttgctcctacaattgctcttaccatgaatcttttcctcctaggaatcattgcaccgttactgtgcgttagtcatatgtctagcgttgcattccctgaagacatttaaacaggaatgcttacacgactagaatacacgaatttatctcataagtaaaatcaatattatttatgtttgtcataatctacaattatcttaatgatgtcgttccgttttaacactttcagcggagcagtcatttcaacccgttaactcgtcaaacagctttgccgctgccggtgacatataggccttatccgaggttacaaggcagaactgtctgtggggcatctcctcctcaaattccagcctgaaaacgcggttcagttcaagcgcttcccgggcaaaccccgacatcaggcatccgacacccagattacgtctggcaaactggacaatcatatcactggtagccagctcaaattccggctccagaaatatccccttttcttccaggaactgatccatgaaccgcctggtactcgttttcttctcaagaaaaatacagggatattccagcagttcacggtaattcactttacggccgcacagttcctctctgaatttgggaccggcaataaaaatattctccacctctttcacagggatgctctttacacccggttttgcctcaaaaggcgtactgataataccgaaatcgattcttccctcattcagaaattccaaagtttccggtgtcggtccattggaaacattcaccttgattttaggatatctctcatgaaaccgttccagataagggagaagataaaactgcagcgtcatgtcgctggctccgatccggatttcccccgtctccaaatcctgtattctcttcagagtatcttccccatcatagatagattcaatacctctttttacataagaatgaagaacttcaccttctctggtcagctttacacctttggaagtccgcagaaacagccggcatcccagcgccgtctcaagctggtgcaccgcctggctcacagccggctgggaaatgcagagtacttccgcagccgccgtgattcctccgcatctgcatacgtaataaaacaccttataatattcgagattgatttttccatgtttatccatcttcagcctccctgttttctatcattcggactcttacagtgtatttgattcccggggctgagtcaatctcaaatggagatttaacttaggtgtggaggacgcgtccggaacggaccatgtccggtgtggtgagggggatggctgagtcttccgtccctggttgaaggttgtcgtgaggtgggaatccggccggaatgaattcttacggggaccgtttgcacttttcgaagcgcatagccgtgctaaattcgtgagaaacctcattaagcacgtatgggcttctatatcccctccagaattgattccgcctccttccccggtccaggttttctccggggacggaagactcaggcgaaggttttcgcacaccggacccggtccgctccgaacgctgattgtctcacgcgttaagtacgggggcggaccgggtcgcggcctctaagcgctttcatatgtgtttgatatatattggatatgggataaagtatttgttagagtatgtttgttggaagtttgatacatttgatgtttcaacagattgatgactatgacctgtgctcggagcgtgcaggttatcgttgtctcacgcgttaaatgcggggatggaccttgtcgcggccacgcagtgctaccgtgtacgggaaatacgatatgccttccatgcgcctttacgaaagaattacgctggatttgataccggcctgccggaaacacatagtggccgcgacaaggctctccccatttaaggttggagacaatcagcgcccggaacggaccatgaccggtgtgcgaaaacctccgcctgagtcttccgtccccggcgataacctgcccggggaagtaggcggaaccaattgcggaggggacatgggagtccgccggtgcttagcgaggtccctcacgagcttagcactgctgcgtactccaaagagtgcaaacggtccccacagcaattcattccgtccggattccccctccacgttcaacctcccacagggatggaagactcagccatccccctcaccacaccggacatggtccgttccggacgcgtcctccggacctcagttaaatctcattatacattaatctccgccttcacgcccaattccgcctgattagcatccagcagaggccgaatcacctcatcaaggaattcttccacctgctcttttgcgcgtccggtgtatctggaaggctccattgccctgtttaactcttccagcgtcagattaaatgccggatcggcggcaatcagttccaggagattattatcaagacctttttccttgacattcttaccggcctccatggaaagcgtacggatcttctcatgcagttcctgcctgtctccgcctgcctttacggcatccatcataatattctccgtagccatgaaaggaagttcggacatcagccgtttttcgattactttcggatacaccacaagcccgtctactacattcagatagagatccaggattccgtcgattgccaggaaaccctccgggatgctgaggcgcttgtttgcagaatcatccagggtccgctcaaaccactgggtggacgcaaccatcatcgggttcatcatatcggccattacatagttggcaagagacgccatacgctcgcttctcatcgggtttctcttatatgccatggcagaggagccgatctgattcttttcaaatggttcttccacttctttaagatgctggagaaggcggatatcgttggaaaatttatgggcgctctgcgcaatgcctgccaggacgctcagcacgcggctgtcaatttttctggaataggtctggccggataccggataacagcctgcaaatcccatcttgtcggcaatcctctgatccagcttcctgcattttgcatgatcgccgtcaaacagctccaggaaactggcctgggtaccggtcgttcctttagaacctaatagcctcagggaatcaatgaggtaatcgagatcatccaaatccagtttcagctccatcatccacagagtcgccctcttgcccaccgtcgtcggctgggccggctggaaatgggtaaatgccagcgtcggctgcgctttgtacttatcggcaaatacggccatctcatggaggacgttgatcagtttcctgcgcaccagcttcagcgcttccgccataataataatatccgtgttgtctcccacatagcaggaggtggcgccgagatggataatacctttcgcctgcggacactggacaccatatgcgtagacatgggacataacatcgtgacgcaccaacttctctctctcttttgccacttcaaaattaatctcgtcctggtgctgcttcaattcgtcaatctgttcctgtgtgataggaaggccgagttccttctccgtctccgccagggcaatccacagctttctccaggttctgaactttttctccggtgagaaaatatactgcatctctttgctggcataacgctctgaaagggggcttacgtatctgtcgtacatgattttacctcacttttctatttctggccgcaccgtcttggctccggtgcataaaaccggcttccaccattcattatagcggaagccgtgtctgttctcaattgctgtttcgccggtattactgtctgtcggcaattccaagacgtctgaatacttcattgtatgcgtcttccacattgcccatatcgcgtctgaaacggtctttatccagtttttcatgagtctctttatcccagagacggcatgtatccggtgatacctcgtcagccaggataatctgtccatgatagcggccgaattcaatcttaaagtcgattaactcgataccaagctcaccgaaatatttacgcattacttcatttaccttgaatgcatattttgtaattgtgtctatctcttcctccgtagccagttccagagacagcgcatagtatttattgataaacggatcgcctaaatcgtcgttcttgtagctgaattccagggttggacacttgaattcgattccttcttccatgcccatcttctttgcaaaactgcctgcggaaaagtttctgataattacctccagcggtacaatctccactttcttaacggccgtctccctgtcgcttaattcctctactaaatgagtcggcactccctccgcctcaagcagtttgaaaatgtgatttgtcatacggttgttgattgcgcccttgcctacgatagttccttttttcagtccgttgaatgctgtggcgtcatccttgtaatctacaattaaaacgtccggatcttcagttgtgtaaactttttttgcttttccttcatataacaaatctacttttttcatctgcattcacctgtcctttttatttataagttttcaatataaaagagcttcatttcagtagaaattataatacaatggctgagtaaaatcaatactgtgttttattaaattaattaataaccactcaggggcgggcattatgaatcgcattatcatccgcgcgctccgtctcggttctctggtggaaaaaaatgatctccccgcttttgatacggacggaaatacggaaaacatcaaaaaaacggccgccattctctgtaccgtattcgaggattgtctgtgtgtccttaagttcctccaccgtcagaaatgcctctttgaatgctcccaccgcggccagatacagcacagcggccaaaaaaatcattgataaagccaatcttcttttcctgctccttctaagccggagcttcctgaaaaaatgtatcaggctcctgcgtctctttctccgtaaacggctgtttcgtaaatcatctgcatgtttgggcaaccgcatcgtctcctttgctgctgcctctcccgcaatatccagtctccaacctaactatagcggattcctgcaaaaatgtaaagaaaaagcggacattctgaaaaaaaccagaaaatccgccaaaaattatatttccgccttctcattgcctatgataaatctctgttcaaattcttctgcaggcattggtttataaaatacaaagccctgaatgtaatcgcaccccaattcctttaggatgttcacgtaaccccttgtctcaacgccttctgcaattactttcatctccagctctttggctgtctccacaatatgtctgacaagaatgcgttctctggtatccgattcattctgaaaaagcgatcggtcgattttaagcgtgttcaaatcagcattggtaagcacactgaatgatgaatatccgcttccgaaatcatccaacgcgcagctgaaaccgaactctcttaattgcttcacaacgcggcttacaagctccacctggttaaggacaatactctccagtagttcaaactcgatgcagtctttgggacatggcaccttattataaacctccttatagtggtccagaaagtaccggtaattaaacatgttgctggaaagattcacactgatccgtatcttttttccgtagagatcgatccatttgttaatataacggcataccttttcaaataaatataaatcgagatcactgatcaggccgttgcggaccagctccggaagaaattcacctaccggaatcatcccccgctccggatttatccatctgaccaatgcctcggcttcatgaacttcccccgttttcagatccactttcggctgcagataaagcttgaatttctcattttccattgccggctgaagcatttgttcaaaatcatagcttgtcagattcttatcctgatatgtcattccatagacttccatatgggaattcctgtaggcagtctccggacactcagaccggcagatatcggcattatattgggccgtgaaataatcggcaggtttttcgggcagcagatatattcccattcccatatataccttgccggtcccctcattatacggcatatcccgcacgtgggcattgaaatcaattaagtaatgaaatatttcatcatagtccttcgacagcttcaccagcatactaaagccgtccacagaaattctggcgacatactcatcttcctttatccattcggaaattgccttatatactttttcaaccagccggtcccccgcctctctcccgaaaagccggttaaaaatacggaatcgctttatcttcaagctaatcagcgcatattcttccggatttttcccgcagacctcctcatatttttcccggagccactgctcatttttcatatcaatcatgatattgtcctctgacttatgtattattctgtatatattctaacttcaattctaccactaagactctgttttcacaacggtgaaacacttacttcgccaacttttcattatcctccgccaccagacgataacctgcatgctccgcgcacagcttaccggcatcaaacgaaaaaacaacccggccggaaattcatctttcccgaccaggctgtctgctgctttttcagtcgtttaatcacccactgaactttccattgtagaggaaaccgtaccgtcgtctacagcatgttccactccgttttttatgtcctctgcaccgtctttaatgtcgtcggcaagtccgtcaagcactcctgtgctttctctcgcatcggtaccgtttgtcggtccgtttgccataccgccttcggtgctttccgcactgattgcagactgagactgtcttgtggattcggtcgatttcgtattattacgtccgtcaccgcatccggatgctaaagccataacaaaaatgagcataaggcctaaaacgatctgtcttgattttttcataataacatctcctttctaccacatagtatgtacagcggagaaaggatttatattgtcaaaaactggaaatttcttttcaggcattcatcagcctatcacatcggccatcgtatacaatccaggctcttttccggccaggaacttggcggcctgaattgctcccttggcaaaaattgcttttgaataagccgtgtgggaaaaggtcaccacctcatcttttcctgcaaaaatcacatcatgttcgccgacaatggagccgccgcggactgcctggatgccgatttcttttttatcgcgttttacacgctcggccgatctgtcatatttataatgataggcatgatccatcgcttcattgatggaatccgccagtgcaatcgccgtgccgctcggcgcatccaccttctgattatgatgcttttctacaatttcaatatcaaagtcagccgcggccagaacctgcgcagcctcccttacgagtttcagaagtacgttgacccccagggacatattggcggagcgcagtaccgctgtcctctcagccacttttgcaacacggctgatctgctcttcagacagacctgtggtacagaccaccacgggcattcccgtcctttcacaccagctgagcatcgtatcggctgctttggcaattgaaaaatcaatcataacatcggctttaacggtacattcgtcaagtgacgtaaataccggaaaggatgtatctttattatctgcaatatctatgcctgccacaatggaaatatcttcatcattttccgcaagccctgcaattactcttcccatggctccattgcagccatgcataatcgctcttaccatcttatgcacctccgcttttccattaaagaagtccgtaatttaccagttcttttctaagtctttctttattctgcggttccatctccaccagaggtttacggaacgggcctacttccttgcccatcatattcattgcctctttaaccggaatcggattcacttcacaaaacagagcatcgattaaaggtatggcatcgagctgcatctttgtgctttttgccgcctcgcccttgaaataaagttcacacatgtcatggacctggcgcggagcgatattggataatacagaaattacgcccttgccccccagggaaagaagcggaacaatctggtcatcgttgccggaatacagatcgacccatccgtccgaaagacttgctatctttgcgattgaagagaaattaccgctggcctcttttacgcccacgatattttccacatttttgcagagatccacgatggtctcagggttgatattgatcccggttcttcccggaatgttatagagcagtatcggaatcttaaccgcctctgcgacctcggtaaaatggattctaaggcccttctgcgtggatttgttataataaggggacacaagtaaaagtccgtccgcccctgcctcctccgcacactttgagagatagaccgccgttgccgtacagttggagcctgtacctgcaatgaccggaatccgtccgttaaccacatcacaggtgaatttaatctccttgatatgttcgtcatgagtcagcgtcgccgactctcctgtcgttccgcagataataatactgtccgttcctcctgctatctgctcttccacgagttcttccagcttggaataattaatttccccgctctctttaaatggcgttaccaacgctactcctgcaccttcaaaaattgacattgtgatatcctccttcaatctgtagtcagacttcctggtttatccgggattcacaggcattctctcttattcctgcgaataaataaagctggcacgtcggccagctcaaaatgtacaacaaatgatcccgtagctccccatcgtttctgatgacagtcatatgattattcatcatatgcccagaacagcacttgcagatacactgttcttcggcgtctttccctttccacggtcatctactgttcctgccacatccggccgcttactgatgatcgacgcaacctctacctcaatatatttgttcttatattatcattacttccggttcttgtcaactgtgaggtttgacaatctgtaaatacaggggttccagattccctgattcaataaatgaaaaaacagtttcagatattggtatcattctcaatccttgtaaccacatcggcatgttccttcacctgcgggggacaaacctttcctgtcagtatcaggctcacgttctcttccctcagggaaagcatattcgagaaatcttccatggacatcaattccaaatccagaaccccgagaaattcatctaaaatcagtaagtcacattcgcaggtggtcagtaccttcttggcaaaattaataccattctggatattaatccgctcttcctgcttctgtgattcattgagtgtgttaaagtagccgcactgcttctcaaagcggaacactttcatatcaggttccagacgcttcagccattctgatgactccgggcttaatgctccctttaagaactgaatcataattacccttttattctttgttatcgctccgatccccttgcccagagccatagacgtctttccaaccccgtcgccgcagataacctgaacaattcccttatccatatacagcacctctttaatctgtgttttaccggtaatcattatgctggcaagtctgagatgtaacgctgttacgttactttaccaggccgacttattctagcacatttttactgcatttgcaagtatctgttacagctcagccttcggccaaactgcaacaaatgatgcacagaaacggcaaaaaagtgccgtttcgcgccgcaaaactcgggattttcacaaaaagcagcgaaaacacctcgcggaatacatcatagctgaactgttataagtatcttacttattcctgctccacacactcaagcttgctgacggatacttcatacgctattctcttctcacaatctgtttcactcagttttttcgtatattccctgctctgtacacgcccccagacgcagactctgctgccaacctcaaagcctgatgcatatctggcatttcttccccatgcaatacagggtatgtagtcggattttccatacggacggttaacggccagcaggagatctgcaatttccctgccaagaggagttttcctgtaaatcggttccttgcagatatagccgtccagaaaaatctggtttgtttttgtataatccgtgaattcttccaggaaattgacctcacggacgaaaatggaaagcacaagtctgttttttgtcccctcatgacggttgtaagaacggaactggccgagagcttccatcgtacagccctgataatcctttgacacgtccagaagacgctccgaaaccatcagagggatgatgtccacctgatcactcagtctgctgacagccatgtctaccacataaaatccttctccaaatacttcatggctgaatttgaattcagaaaccacttctccaattacactcaccttgttgttttcaatcactttttctgacatagtacttctctcctctttctttccactaaatttcttttctattcttttatcttgcaatcgtcctttcagaatcacgatcagatacaattgctaatataatgtttatgcagaaaattccagtttagaagatatttcgaatcaaagatttctacaggaaaagacaatcggaggagacaaaaagggacgcccagaaaagcgtcccctgtcgtttttatttaatttatacggctcggcggcctgtcatatcaggcttttccccaatcagcctttatcttttctgctgattgcggacctctttctcattgtcggatcgaggatttttttgcggatacgcaggcttgtgggcgttacttcgagaagctcatccgtatcgataaagtccaggcactgttccaggctcatctcttttggcgtagtcagcctgagcgcttcatcggcgctggaagaacgtgtattggtcagctttttcgtcttgcagacgttcagctcaatatcctcaggcttcgcgctctgtccgataatcataccggaataaacctttacgcccggcccgataaagagggttcccctctcctgtgcattgaaaaggccgtaggtaatggattcgcctgcctcaaaggcaatcagcgagccctgcttgcggtaattaagttcgcccttaaaggggccgtatccgtcaaagctggtgttcagaataccgtttccctttgtatcggtcataaactcgccgcggtaaccaatcagccccctggacggaatggcaaattcaagtctggtatatcctccgccgatcgggctcatgccctgaagctcacccttgcggcttgtaagcttctggataacggcgccggtaaactcttccggaacatcgatataggcgatctccatcggctccagttttctgtttctctcgtcgtaatgatagagaacctccgccttgctgactgcaaattcaaagccttctcttctcatattttcaatgaggaccgacaggtgaagttcgccgcggcccgaaactttaaaacagtcgggagaatccgtttcctccacccggaggctgacgtccgtgttaagctcccggaacagtctttccctgatgtggcgggaagtgatatatttcccctcctggcctgccaaagggctgtcgtttaccataaaatccatggcaatggtcggctcggatattttctggaacggaatggcctccgggtttaacggagaacagatggtgtcgccgatatggatatccgcaataccggaaatcgctacaatcgagccaatccccgcctccgtcacctccactttgttaaggccttcaaactcatacagcttgccgatcttcaccttgcggaatttgtcaggctcgtgatggttcacaatcacacattcctgatttactttgagggttccgttatccactttgccgacaccgattcttcccacgtactcattataatcaatggtgctgatcagaacctgggtctcagcctccggatctccttccggagccggaatatattcaagaatcgtctcaaaaagcgcggacatgtcctcttccggatcattgatatcctttttggcaaatccggctcttgcggatgcgtaaatgaacgggcactccaactgttcatcagatgcatccagatccataaacaattccagaatctcatccaccacatcatccggtctggcttcagggcggtctattttattgatgcagactataaccggaagatccagatccagtgcctttctcagaacaaatttcgtctgaggcatcgcgccctcatatgcgtccacaacaaggacaacgccgttaaccatcttaagaacccgctcaacctcgccgccgaaatcggcatggcccggcgtatcaatgatgttgattttcgtaccattataattgaccgcagtattttttgataaaattgtaataccgcgctcccgctcaatatcattggagtccataacacggtcacaaactacctggttctcgcggaatattccgctctgtctcagtaattgatccaccagggtagtcttgccatgatcgacgtgagcaataattgcaatgtttctgacatcttcacgtttcatattcataatctaatctatctctctttcctgtcaaacagctgctgtgttttttttacatatttttacacagttattcattttaacattaaataaagaagagttcaaggggaatccgaatgaaatttttcatataacacttacaaaatcactatttctttgccgttttccccgtaatatactttgtccagcagctctgtccggcaccggccggcagttccctccgtcagctttttcttaagtccgtccgcttctgagaccggagccaggaccgtaaccgcaaccgaatcactgtaatcgctgtcgaggattgttattttctgttctccgagaatatactggattttccctaaatcgctatagtccgtctttatcaccagtttctcggccagtattttctccaggaccacacattgattaagtccctctttcacagcctgggaataggctctgaccaggcccccggttcccagaagtgttcccccgaaataccgggttacaaccgcgcagacgttatggatttcttctcccagaagcacatccagcatcggccgccccgccgtctgggccggttcgccgtcatcgctgcatctggttacctcattgttctctcccaccgtaaatgcagaacagttgtgtgatgcatcccagtattgtttcttcatcatcgctataaatgccgcagcctcctcctccgattccaccggccggattgtggctataaacctggattttttttcaacggtttctccctctccgcctctatataaaactctgtatctgtctctcatcttttacctcctgctccccgtttctttccatatttaaggccgggccttaccacaaaatgatgtcctccattcataataacgtaaaaaaaatttcatgacaatagtatttatttatcaggaacaatttgctataatgatagcttataaaggaggctcctatgaactatggcagaaaatctacaaaacgaagaataaaggcagccagctcccggaagaaaaaatatacgaataaagtatttttatcattttttaaaacggtttttgtcctgtttctctttgtggccgtcacgggaatcagcaccggaatcggaatgtttaaaggcattatcgacagcgcgccggatttcaatccggacagctttgcgccaagcggctatttttccactatctataacgccaacggggaggtaaccgatactctgatcggaaccgatgccaaccgtattgaggctacctatgacgagctgccgcaggatctgatcgatgcctttgtggctattgaagattcccgtttctggcagcataacggaattgatctccgctcgataaccagggcggcggtgggcgtcctgacacataattacagcggaggcgccagcaccctgactcagcagctgattaagaacaccgtttttaacggcggtatggagacaagcgacggcgccaagattgaacgtaaaatccaggaacagtatctggccctgcagctgacgaaaaatgtggatcgtaaaataatcctgaccaattacctgaacacgattaacctgggaaagaacaccctcggagtcaaatcggcggcgctgcgctattttaataaggacgtctcagatctgacgctttccgaatgcgcggttatcgcaggaatcacaaagaatccttccaagctgaatcccgtatccggccccgatgccaatgccgagcggcgtgaggtcattcttcaggagatgtacaatcagggctacatcacaaaggaagagcaggaagaagctctggccgacgatgtctattcacgtatccagaatgtggatcttgccatcaaagaaagctccactccgtattcttattatacggacgagctgattgagcaggtcacagacgccctgaaggaagaattcggctacaccgacacacaggcctccaatctcttgttcagcggcggccttcagattgagacaccgcaggatccggcgattcaggccattgtcgacgaggaaatcaacaaccctgagaattacgatgcggcgcgtctgtccgtggaatacaggctgtctatcacccatgcggacggtaccaccgagcatttttcacaggagacaatgagaacttatttccgacaggtcaaagggaagacaagctatgacggacttttcgacagtgaggctgagatacaggcggcaatcgacgaatataaggcatcactgctgaaggacggcgataagatcatcggagaatcctcgaatatcacgctacagccacaggcatcctttgttctgattgaacagtcaaccggttatgtcaaggccatcagcggcgggcggggcgagaaaaaagccaaccggacactgaaccgcgctacgaatacattgaaacagcccggctccacctttaaagtcataactgcatttgctcccgccatcgatacgtgcggcgccacacttgccagtgtatactacgatgcgccttatacggtgggaagcaaaacctttaaaaactggtggggcggcgattataaaggatatcattccatccgggacggtattgtttactctatgaatattatcgctctgcgctgtatggcagagacggtcacgccgcagcttggtgtggagtatgcggaaaagctgggaatcacaagccttgtctcctccgacttaaacctttcaaccgccctcggcggcatcacgaagggcgtttccacgctggaactgacgaatgcatttgctgctattgcaaatcacggcacttatacgaaaccgattttctttacaaggattctggatcgcaacggaaaagtcctgatcgagaatgtacctgagacaaggcaggcattaaaggagtccactgccttccttctgactgacgcaatgaccgatgtaatgcagagtaatgtcatgtatacacggcccggcgcaggcattaatgcgaccggcagctccgccgccatccccggcatgacgacagccggaaagagcggtactacctccgataataacgatatctggttcgtgggatactctccttattatactgccggaatctggggaggctgtgacaacaatcagaagctgaaggacgaacacggttcaaggaacgggggaaccagctttgccaaacgtatttggagaaagattatgacacgggtccatgacggcatgtccgatcctggtttcccaatgcctgacggcattgagactgcccaggtatgcaggaaatcgggcaagcttgcagtaccgggcgtgtgcagcagcgacccaagaggcaatgccgtttacaccgaatattttgccaaaggcaccgcaccgaccgaagcctgtgatcaccatgtgagagttaccgtatgcgcagtatcaggcggacggcccacggccttctgtcctcccgatcagcaggaagcgcggacctttatggcactgcctgccgatgaaggcgttacggacgattcctactatgcaatgccggattactgcacggtgcataacggctcctccacaattattgatccgtcccagacggacggaagcgatatcccatttggtcccggttatataccggagacaacggctccttattctaagccatatgaatactactcttatcccaggtcttccggagacggtaacacaattccgatagtgccggcaggtcccaacggataggtgtatgtaaaagggagactgaaaaagcacagattctgctttttcagcctccctttctatcctccggcagcgtccctgagtgagaaaattaaagctctgtaacaaagagctattcccccatgccagcagccgggacggaagagataagaaaatgttgaaaggcggccatatccgtcccgtccggatgtgtcagagccgcatggtagttatccaccataagctttgcccgtccgtcctgcggatttgcttccagcatactcctgtatcgttccagcacaccctgctgcatttttccctgacacataaatgaagctttcaatttgacggattccggaagctcacaggcagcagcctgaataatccggtcataataggcctgatccgcaccaaagccggcagtgccgaacaaaatgatctccggcggcatattatccgtcttccccagctctttaaataaactgagtataccgctgtctgcatttcctttgtcggtccaaaaccccgcatacaatatttcggcttccctgaaccgctgtgcggttgctccctcaagcggtccggccggtacttctccaaagtaaacgcactctccgccttccctttctccaagtacttcaaacgctttttcggccagctgtctggtattgccggtccggctgctgtatacaattgcatatttcattgcacatcctccttctttttatcatagatacagtgtactccccgatgctccatcatccctcccaggcattcccggttgcagcggacacagaaccggatcttatcctggttttttcctgctgttttatttggccattcgggatccgcaatcaactgacggctcattgcggcataatcaatcctggaccgtgttaactgctcctccacaaaatccgggtttgtcagccctccgaccgcacagaccggaagggaagaatatttcttcacttcatcacagtattttaaaaagcagccctctccggaaaaataggggtgggattttggaggaatcgtatctgaaagggaggaatggtccgccagcgcaacatgataactgtcaacacccgccttctccagaagaggcaggaaaacaggcagctcctccaccagaattccggcattgccataatgcggattttcctgacgcactgccagtttgtattcgacaggcatatcgggaagagcctgtctgacggctgcaatacactcacaggcaaatttggccctgttggccgcacttgcgccgtaggagtcggttctatgattgaatacggaggaactgaagcttccgcacatcctgtccccatgaacctgaatcatgtcaaagccggcttttccggccaaaaccgccgcatctccaaaggatgcggtaatctttcctattttagattccggtatcccggtaatataagggcctgtcctctcattcatcagctcgcgcagccggtccggcgtaattctcttcatcagcattccgggcacgaagcgcagcattccttttatatcggaatccgaaacatgtagctgagcgcaggcctttgccccgtttttatgtatgacctccgtcactctgcggtaaaattcaaatccttttgtgctgtagagtgatttcgcaaaaagactgtgccttaaaaccggaacgtcaccgatcaccagcatcgccgctcccccggccgctattattcccagccgctccaaatactcctcttctgaaagtcccatcgttgtaggcgcaaatacgattctgtttttaagtttcagcccgcggattgaaaggggctcgtttattttttcatacataaatgagcctccttcgtctttcccagcttttggagaagggtaaacaactgctttttctcttcttcctgcaaggacgagagcaccttgtcatcccattcgtggaacagggaatgtgccttttcaaaagtcttttcccccttcatggtcagagtcagaatcgccatccgtttatccttttcgtggcgcctgcgctctataaagccgtcctgaagcagcttttcgacggaacgcgccgcatatccctcgtccgcccgcacagccgcagccagctccctctgggagcagcccggtttctttccgatatagatcacgaaatataaaagtccgagggaaatgccctccttctgaagctccgacttgcaaaaaagcgtgaaatcttccctgaatatggtagtatagtaagcaaatgtctgctccattctgttctcctttcaaatacttgatattatcaagtataatggattatttgataatgtcaagtattcgaaggctgaaattggaaatttaactgaggtttggaggacgcgtccggaacggaccatgtccggtgtggtgagtgggcaaaggggacagttcactgagtcttccgtccccgatggaaacctgactcggggatggaagactcaggcggaggttttcgcacaccggccccggtccgttccgggcgctgagcggcctcgacaaggtccgctcccgcacttaacgcgcgagacattcagcgtccgcaggccagcggacggggccgatacccttggcggagtctttcgtcccggtgataaccttccgggagaaggagatactgccgacatcttcctgcggggaaggagagaatgatatccggaaggacgttcatctgagagtcgatagctcttaggcagagggaggcaaagcgcgccgggcggattttggcccttcaagggcaaaatccgggacaagtgagcttcgaactcatccggagttcggagcgaatttgtccggaaccccggagggctttgccttccactgtcttagagctatccctcgaaagggcagtccagccggatatcattctctccggctccgccctgcgaaaacgaaaccacagtatctccttctccagccagcgataccactcccccgggacgaaagactcatatacacaccccaccaccccgtccgctggccgttccggcggcgtcctcacctgcttaattaaatctctaccccttcattttcggcttgaaaatcagagaagcaatataaccaaatatcaaagcacccgatattccggctgaaccggcggtaaatccgcctttaaacagcccaagtataccgtccttgccgacagcctcgctaacgcccttccacagggtattaccaaagccaagcagcgggatggtagccccggctccggcccactcggcaaacggttcatagattcctatccagccgaggactgcccctgtaactacaagcagcaccataatccgtcctggaaggagctttgtcttgtccattaatatctgtaccgcggcacaaatcaggccgcctatcagaaatgcttttatataatccatatctctatttattcctccattccgattgtgtccgctcaggctcctatatgctcgagcattaccgcatgggcaattccgggaacattctgaccctcgttgaagctgatctgggaaagcagcgcgccggtcggcacaaaaagcactctcttccactccccgctgcgcagcttcggaagaatatagccgcataatgtcacggccgaacagccgcagccgcttccgccggagtgtgtatcctgaacagccgaatcaaagatcgtcataccgcagtccatatgaatccctttcacatcatggcctgccttatccatgaagtcaaaaagaatattttgtccgactgagccgagatctcccgtgattatcttgtcataataagtctgatccacttcataatccctgaaattctgcaaaatcgtatctactgccgccattgccattgccgctcccatgttcatggaatcccttgactgcatatccactatttttcccgccgtagccccggtaacctttgcatagatctcttcctgcgcggagggactctccttcccatcctttcccacgataacagaaccgcagcctgttaccgtccaggtcgtcgaaagcggtctctgattgccgtatgccagcggaaaacggaactggcgttccgcagaagcaaagtggctcgacgccagagccatcacacggtccgcataacctgcgtttaccgtcatggaagccagcatgattgcctctcccatggttgagcaggcaccgtacagaccgaacaccggtatctccaaatcctgcacgccgaaagaagtagccacgatctgtcccagaagatctcctgcaaacagataccggatatcgctttccttaagccctgatttttccaggcatttgagagccgtctgtctctggaactcgctctcggccgcctcccagctatcctgtccgtacatcggatccggctccaccctgtcgaaacaggatttaagcgggccttcgccttctttttcaccgacgatcgatgccgctcccataatcaccggttccttatcaaattttatgctcgcttttcctttctgcatctcacctgctccttccttttactgattcagcccgaaaccgaatatcacactgataacaccgagcgcccaggacaccagaaccccgtagaggataaccggcccggcgattgtgaatatcttgcagcccacaccaaaaacctggccttccgctttgtactcaatggcgggggcagccacagagttggcaaaaccggttatgggtacaagtaccccggctccggcgaagcatgcaattttctgaaatatgttaagtcctgtcagaacaacacttaaaagaatcaggattaacagcgtccatgctgcagccgcatccttttcaagccctccctctttaaaaagattcagcagaatctgaccgatcatgcagattagccctccggttaaaaaggccgccaaaacatttttaaaggtactgtgtaccggtgtcttttgctttacatactcgccatattgttttttatctatttccatctgctatgcgcctcctgtctttcttcaaaatctctaacttactaaaatgtgcagcatcagcttcccatgcctcccagaaagtagaccaggcagccgaataattttccgagggcaacggataaaatcacatactggagccccacggcaagccggatccttctgctgataaccgggagagccttcagtgtttccgccagggacatgacaagacagccgacaaagatgccgctgcaaagtccgaaaatccccagcacaagatggcccagaatcggtatccccagacctctggcgccaaacagcatcggaaattcaaaaatatccagcacgtttccgaaaattccgccgataatgataacggtctcgtaaagaagaatatgacggcttgtccccgtttttccaatcacccggggaaagacccctatgatggccaaaaaagcaaaaacgccggccgctatgacgccgccggcacataatccgataaaaaccagaagagactgtctaagaaacatctacgccagactcctttcttccgtcattctgaatcagggttttattgatattatcttcatataaacgcatttccacttcaagcggcgtcggatccgtattcagcttgagctttgcaaaatggttaaagaatacgataattcccagcgcaaggccgactgagtaggaggtttccagtatggtcagtccatccgactcctgtcccatgataagacggtaaagctccttaaatacatccagtacgctggcatcgttgttaaaagtcataattgcaaatgccgcgcctgaaaaacacaccaggcagacaaaaatagttttcagccactgccaggtgtacattggctttttagatggctgataatcaatgataaaatctgtttctcctacactgttgacttccgcttccggaacattttcagaaattttctgaacaacgtccacaatgctgcccatataccgtttttcctgatccgaatggattgtctgcactttcaccgctttgcagcggctggccgtgcttttgtcactgcagtaaacatctgcaatgtcactcaggaatacatcttttttatggacctgggtaatctggcttagttttacatatactgtctgtgtcatgctgccatctccatttcttccctgatttccaggtttctgacgaaggtgccgtcaacatgggatgagttacggcccacggtcagaagacagtaccatactacggccacgatagccgccatacagcagagcagtatgattaatcctgttttttttcgcagattcatgtcacttcacatccttttcctctgaactgtttagggatagtatggtgcaaagacggatttttattctctgtaaaaataatttaatatgaagatcggaaacagggaggcggcccctgtctttgccgtctccctgttttaccttcctatgaaaccatacctacagtttttcacgcatctcacgcagtattttccgttccattctggacacctgcacctgggagattccaaggatctccgctatctgggtctgggtctgattataaaaataccgtcggactatgatttccctctgctttttctccagtgatttcagaagctctcccagaaccatgcggtccagaagcatttcattttcttctttttcttccgccaccttgtcgatgagggacaaggtattatcctctcccgaaccggaaggcgcatagagtgattcaacctggcagccggcttcaagggatgccgccacctcctctttactgacctctaaagcttctgaaatctcctccagcgtaggctcgcgtcccagggaacccgacaggctctcacggaccgcgcttaccttaaagcccagttctttgatggaacggcttaccttgatcattccgtcatccctgagaaacctcttgatttctcccgtgatcatgggaactgcgtaggtggaaaaccgtacgtcataggaagtatcaaatttgtcgattgccttgattagaccgatacttccaatttgaaacaaatcttctgtctcacatcctcttcccgtaaaacgtctgacaatactccagacaagtcctacgttgtccattaccagcctttctctggctgctttatccccgctgtgagccatctcgatcagtttcatggtctcatccatagagtcacctgccgattttctttttcatttttaccatagttccccggcctggctctgattccacctccacctgatccatgaacgcctccataaaagagaatcccataccggaacgctccccggaggtatcgctggtatacatgggctccatcgcaatcctgatatcttcaattcctttcccttcgtccctgatccatacggaaagctcatcttcctcaataccggcttctatgtaaataattccttccccgttcccatatccgtgtatgacacagttggttaccgcctctgaaactgcggtttttacatcgttaatttcttcgagggtcggatccatgcggctcatgaatacggctaccgtaaccctggcaaactcctcattttccgaccggctctcaatctgcattttcatccattcttttctgggcatttttccggctccctgttcttttatatccatatttaattgaatttcctgcatggtctgtcccgccttcacactattctcctctctttccttatccatagattgcctcttcccttgtatcacactttttgacaagtctcattatccctcctatcgtcaggattctcgttattctcggacctgcgccgtaaatgcggaccgttccccggctgccctccatctgtttgtaccggctcagcaagactccgattccggaactgtccataaattccgtgtttgaaaaatcaaaaacaattttgttgatataattttcttccatcagaagatccgtttcatatttcagattacggcagttatgatgatccagttccttcggcagatggatgattagagcctgtccgtctgcctcataggtaaaaagttcattctgcatttttatatgctcctttcgatatttcaataataatctgctgctttaaattcaatgaaaaaagaagacactacgggtatcatcatttatcttccgtagtgtcttctatcatgttgctgctttgcgccctttgccgtttattctccggctgcgctgctttcttccggagcgctgctttcaccggccggagcctgcgtctcatctgcagccggctgggtttcacctgtacccgcacccgctgcgccggcccccgcagtaccggttcccgcagcaccgccgttacccgaatccgcctgcgacggctctgttcccgatggattttgatttcccatcgactgccccggcgcaccggccgcctcgctctgcggcgccagctccgccaactggcttctcgccctgtcggcatattccgaatcggcaaactgggtgacgacctgggtgaaaagctgaacggccgtatccgtctgtccctgggagcggttaatcatcgccatattaaagataaccttagggttatccggcctgatgctcagacaggtctgatagtagctcaacgcctcgctcagtcttcctgcggaccacatcgtataagccaggtcctccagagtctggtatccgttagtctctatatcctgcttcaccgcattggcaatggcaagatctttttcatccgtaaacagggccggattaaaaccggcataaagggataccgcttccgtcaggttattatttctgtacgcctgcaatatttttaccagaatactgtactggtttaccacgctttcattgctgtttaagaagttgtttaactgctcttccgccgaatccttatcgcttttataagtctcaatgctgttgttcaggctggagatttcctcatttttctgattgagctgctcattatactggagtatctcctggttgtgttcgttatttaatttcttcgtcgcggccggcatgacaagaaaaaagataaccgccgcgcccaaaaggagtcccgcaccgatattgagtacggactgccacccggtattctctttgtagctgggcggaataatgacatcgtcatcctgcatctgcctgtgggaaaatgcatttttaatctttctgcgctcaatctcagcctttcccgtcctggccttgacaatcgacatataccaggatgccttgggattatttttatctatttttaatactttatagagagattttcccgccttggtatagtcttcgtgactgatatacagcagcgccagcagcaaatgcgccttaatgaacttcggattggcttccaccacacgtgtaagctgcaggaccgccagatcgtcgcttccgctctgagcctgctggagagccagattatacttcttcacattctggctgaccacctcgaggcgttccggttttctctgtatctgctccagataatgatccgccctgttgtcattctcctggaaattcatgcttataacccactgtacaagcgcctccgagatctctcccatctcataatatataaggcccagcagatttctcgcttctatatggtatttattcaggttcaggcacttttgcagatactgtaccgcacctgtcaaatctcgtattctcgccagttccagcccggtattgtaaaagctgttggaaaccaggcggatttttttcatctgatccattcttaccgcctattctttcattctctttaaaagttcaatcatgatgtcggacatatccgtcaaatcactttttacaatcgcctcgccgatatcttccacctcaaggcttggtttaaaccgctctatttcactgtcaaaatcaattgccaatacttcttcgctcatgctttattcctcctcagcacatcctttatctctccgatcaaatagagagaacctgcgcagaaaaccgtatcctctgcttttttctcattaacagcctcttttaatgcttcctccaccgttttaatcacccggatatcgtggccgcttccattggccattgttccggcccggccgtctacagcattccaggcatcgtgggcggcctgattaagttcattaatcgccagtccccgtccatattctatctgtgtcagaatcagcacatccggcataaattccctgcagagaatctccgccatctcacggtattccttatctgaaaccacggcaaacacaaggattttcctgccgccgtgcctggcggcaatcgtcctggccgcttttgcaaattcacggattccgccctcattgtgggcgccgtccagatagacgtccttcatgatctgctccatccgtccgggccatacggcctgtccgatacctctgcagattacatccccgccgattcccataagctcagcagtgcggaatgccagcatagagttcaccgcctgatattcggcggcaaacgggatatcgagacggtattctctgtccccatccttattctttgccaaaagctttaagtgatcgccgtcaagctccagtccgctgtaggacgtattgtccaccggccaggccctgctgcccatctcttccgctttcgccctgatgacggatgacgcctcggccgatgtattatcgaatattacgggtacgccggctttgataataccggccttctctcctgcaatcttagatactgtgtcacccaggtattccatatgatccaggctgacagacgtaatcacggccgccaggggatgctccacacaatttgtcgcgtccagacgcccgccgagtcctgtctccaaaattacataatcgcagggtgattcttttaccataaccataaacattaaaaataaaaactcaaagtaggagggatggcccgcccctatttctccgaatgcttcgagcgcgtcacaaaccttccggaatgcaaacaaaaataattcatcctccacatcacgtccgttaaaagcaaacctttcccggatcgaaagcaggtggggggatgtaaatacagcaaagctatgtccggactccctgagaatggatgacagaaatgcacagacagagccttttccattggtacctgcaatatgcacgattttcatatcctcctgagaaattcccagaattttcagcatttccctgacagtttccacagtatgcttctctttagaaaacttcggtatctgatccagatattctgctgcttcattcacagctgcgttctgttctttcatcatatcttccatctttctgcctgaaggcctttatctgtaaacggcagtaaccgttcaagctgtcaaaactttgacaatcggtaataccgcttcatgtataaaataatggttttactttactattataatatacatcaggtattatgcaaggagtttatttcggtattttttctgatatatcgacacgttactgttcatatggcaatgtcatttagttaacagtgcaataaagagagatttagttaagcaggtgaggacgccgctggcctgcggccgctgatagtctcacgcgttaagtgcggggggcggaccttgtcgcggccactcagtgctaccgtgtgcgggaaatacgatatgccatcaatggactttttaaaaaattgcggaagattttgatatcggcctgccggaaacacgtagtggtcgcgacagggtcctccccatttaaggttggagacaatcagcgcccggaacggaccatgtccggtgtcgcaaaaatctccgcctgagtcttccgtccccggcggaaacctgaccgggggaaggaggcggaatcaattctggaggggacatggaagcccatccgtgcttaatgaggtttctcacgaatttagcacggctatgcgcttcgaagagtgcaaacggtccccgtaagaattcattccgaccggattcccccctcacgacaaccttcaaccggggatggaagactcagccatccccctcaccacaccggacatggtccgttccggacgcgtcctccgggcctcagttaaatctccaatttattgcactgttaactaaatgacattggttcatatggttttctcccacgaggtgttttcgtgcgctttctgcacaaaaatcccgagttatacggaggcgctgcgggcctgtctgagccggttaaagaaaagaccgggcagactttttttcccatctgcctggtcttctttttctgttgaaggcggtgacctgtgcgcggagcgtgcaggttatcgttattatatgatacggggcggccgacggcctgttttcccctaccggttcgtaaatatatccactaccgcatggaagatctttgttaataccctccacattcttgtgaacggaccaacctcctcatcctccgcatcctccatatcggagatatcggtggcctcgtcatcgtcactgatttcatccgtccggagtataatctgcaggctgtggggcgaaggatttttcgatgaagtaaaggaaattttgtctgcctccggatcaatattgaggaaattattttcatcctcgtatttatccaattgctcatccagcgtatccttcatgccctcgctggccgttctcaccgccgtgatactgtcgagcgtggtcagactcttatcgagcagcccacggaggccctccaggctgttcttcgtacctgcatcaagggaatcacctgctgctatcatggtcgtgtttacaaggctcagcatgtcatgtgtgctgcccattgccctggtcaggcggttcagaagttcctgtgtgtccgccagtgaatccagcatggagggaacataactgtctgccgtgtcaattaatactctcgtatcgtcaagaagattgatcaattcatcggtcacgcttctgagcgctgagactgtggaggctgttttgtgtccaacattcccaacatcactgcatacggcgttgatttttccaattacctgagccgcggactgctgcacagcggtgccgtccccgatcatggcctgaattttctggagaatagcgcccacttccgccggataggaggttccggacagtgactggagtacttcctctacattgtcggcatatgggtccagttcctcactccattcgtcaaaactctcattgttcactccaccgcttcccggaaggccggaagggccgccctgcagggcgctcaaatccgactcagcgccgaatgcctgaatctgcgcttccccgtcactcttctgtgcctgtggggcgctttccgtatccgtatctttcgatggcaaaaattttccggcattttccggtgtttccggaacggatgcattctccatttctgccgtttttccggctccttctgcggtttccgttcctgccggattttccgttcctgctgtgctttccgttcctgacgtactttccgttcctgacgtgctttccgttcctgacgtactttccgttcctgacgtgctttctgttcctgacggattttcagcgcctgttggtttttttgtctcttctggttttgtttcttctggttttgtctcttctggtttacccgtgttatcactgccgggagccgtattttctgctcccacagaaccggctggttttttctttctgttatatcggaaggaatcagccgacttaaggctctcctccagcctttccagatcgtcggatgccagtccgtaagcgcctgaacttcctccgagctggcctgccaaagcctccagaatctgctgtatctccgctgtctgctgactgatcgcagccgccagctgcttctgctcttcctctgtgattcccttaccgattctgtccgacatcgtgttcagggaattcttcagtcctcccagcctgtcatacagccgatccagctcatcctgggtatcctccattgtgttgtagatagcatccatattggcattgatatccgtcaccgcgtttctggctgtttccaggtatggaatgaccctggaggtctgttcggtaactgaggccagatcattcagggcttgggttgacagagcttctatctgcttcctgttcccatttatctgccctctggcgtcatcaagggaattcaagcctcccttcacctgggttacatccattttcatggcttccattgagcgcagaagctggttcatgctgtcgtacattttatcgccgtcctcgcgccaggtatccttcgcctcttttaaatccttaatattatttaacgcatccattgtgccgggcaccatcatcatgataatccccacactctcataatcatcggtgccgatacgcactgtatagtccccgtcttcacccggaagggcggcaaacataaccacggtattatttcccaccgactggagctgggagccaggggcgtccacactgtaacatttttccatatccaccgggactactacggtcagtatcatattattcttgtaataagccctggccgccttgttggcaaatgccttgacattaatttccacaagaccggatgcgccggacagctttgacgcgtcggcctccaccccattcagcttatatgaaatatcaaatgtccacggaagctctgtcgtgccgtccggcatcgtacactggtaataaaaccgtttgctgccctccggaagctgccaggtaacgcttccgtcacccagttcgggttctgtcttatctgtcatattgactaccttgtcatagactccgtaatctgtataacgctccacgccgttggtactgcatcctttcactacgttgaccgttgtcatgtttccgtaatagtccatattgacatacatcgtttcgtcgacctgaacacggggagccgccgccctgacaggcgatgccacactcatggacagcgtgactgccgccattaatactgctgtttttcttctatgtctcatgaccttcaagcctccttcttatcctcgccgctgccgttttttccgggtttcacttttcccgccattcttctgaaccgttcccgccttctcattctccgcttctcaaagaatttccggatccgttcaaactcattatccatcaggatattgtcgaacagcacgagaaaggccggaagcagggtgcataccagaagcatgctcatccacgctcctcttcctatcagatgtcccagatctccgatggcggccaccgaagaaatgttgtataaaatataaccaactatagtcaggattgagccggatgtaaggatagccggaatgctcatgttaagagcctggatagctgcctccctcttttccgcctgtttcctgcattccagataattgttcgtggtcagaatcgcgtaatctaccgtggctccgagctgaatacagcttacgatgatatatcccatgaaaatcatcgtatctcccttaatatagggaactgccatattaataaaaatcgccacctcgatggggatcatgatgatcaccggtatggccaccgatttgaaactgaacatcactacaaagaagacgcctaacagcgacagaacattcactctgctgtaatcctttgtgattgtcgtctcaatatcctgggtggaaggtgtcgttcccaccaggtaggaattttccggataatattttttcatcaatgcctgaatctcatcggaacactgataggccagcttgctctcgcccttgcttctgacgtaaatcaggattctggaatagtcattcttatgtagctgctccgtaatgctttttggaagaaattcctcaggcacaccatccggaagagagccggccatcgaggttacggattttgtatacgcaagtgcttccacttcgtcggtaaaagctttttcatctatcagcgaagtgttcggcaccagggccatcatcatattgctgcggccgaatttggcattgatcagctgctcgtcgtcgtaaacctttgttccctcactggctcccaccgcatcattaccgaacagaaaacgattcatattctgcgccgtataagccggtatcacgaatattgcgacaaaaatcagcacgccgtaccggatacggtaaatcccgcggctgagcttatcaaatcccggcataaatgaacggtgtcccgttttttcaatcatcggcgtcagcctcagtatcatggccggcatgaagaataccaccgtcagcaggctgaagattataccttttgccagtacgattcccatgtcaaatccgatattaaatttcataaaggccaaaacaatgaatcccacgatcgttgtaaggctgctggcgaaaatggaattcagcgcttcattgatggcattcgtcagagccgtcatctgatccagacctttatttttttccctggtaaacgcatgaatcaggaaaatggagtaatccatcgataccgcaagctgaaggacggccgacacgctgttggtcaggaatgagatttcccccaggaaaatgttggttcctttgttgatcagtatcgccactcccatgacaatcagatacaaaaccggttcaaaccaggagtttgtcgtcaggcagagaataataaagatcatcagtacgccaagagtaagtatcagcttcatctctttcgtcacattctcggccagcgatttattctgcaccgccatgcccacataatggcccttttccccggtgatttcctgcatcgcatcaatcgccctggaggttttccggctggtgtcgcctttttcaaagacgatatccatgacggcagaaccgtctttatagtaatcatcaatactgttgaagttgataaatgcgtcggaagaaaagacatccgttccggtatccagccacatgatctgatccacaccgtcaaccttttccagcttatccttatactgcttagcttcatacagtgttacatcttcaatcataacccgtccggtacccggatagccgaatttctcttccatcagatccagtccggctttagactgtaccgtgtccggaagataccgtgtgagatcataattgatattgacaaagggagccgccagcattgaaagaagcacggctatcacaaatacaatctcaatggcccggcttctctctatgatgaatacaggaagagaaaaggaaccctttttttcttcaagctgttttcttttatcacgcaaaaatttcagtctcatgtttccctgctcctgtctgtttcctgctgcattcacggccctgctgaaaattcagcgccgtataaatggcagccgttacctcataaaaatcaccatataataatcttttccattgaccttttcatgggcaagccccatctctttataataaaccgcacgatcggaacgcttcttttcatcactgttatggtttctcaacagcttatcctcagccgcatccgctccgtcgcagttcatcagatagacttccataatgcgtctgccgctgttatagccgattgctttcaaatactcgctcagtgtgccctcatccggtatttttccgctgccgtagccctttgtcctggccatttgaagacgatgctccgcaatctcctgcagcctgccgtttatgacatagcttgcatccttgtcataattctttttatcgtcctcgtaataatcgtcttcctcgtcaccgtcaaacgaatcctctttcagttcattcagattgtcggcaagtgcctgaagctccgtattataaaagccgaccggaaaagctccgccgcccgtgtttttctcgcgcctggcactcgcaaagctgccatccgcattgaacgtatactgggtttcatctttcctcagagtactgttctgcattgtgccgttatcgcggaaataatagtgtttgccgtccacctttttccatccggtggccataatgcccgattcatccagataataccaggcatcgccctcatggaaccagcccgtctgcctgttcccgtcctctccaatcctgtaccagtttccgtctgcctccagccagcccggcgcggccgccgtaccgctctcagttatgtatttccatcttccttcattatcctgctgccagcttccgctgtctgccattgcaggcactgtcattccaagtgttagtgccaggcagagtgccgctcccgggaacaatcttaatttcttcatttttcctgaatccatctttttatttctatataagttattctcattattcatctggtttccactctttcttcatgaatatggggcagggccgtgaatagtaaccccggcccaagcgtatctgcaagccgtcagccctgtggtgtagaaaatttattttcttcccattcggcttttctctcttccgacactgcccggatcattgccgccacttctctgtccgtaaaatggctactgtcgatcatcaggtcgtagctgcttctgtccccccactttttcttagcgtaatagttataataatttcttctgattttatcggcctgacggacaagataaagagcctcctccccgtctgtctcataccgccttctgatttcctcaaccctggcctccagaggcgcatagataaatacggatatcagcccctcctgcttctccaaaaccttatcggcacatctgcctacaatgacgcaggagcctgcatctgcatattttctaatcagttcagactgaatcgcaaaaagtgtatcattcatcggttttccatatcctgtatattgatttgacttcgcaggaactttaaaaagaaaacggttggccttcatctcgtcagcctcttccagttcttttgtctcaaaaccgctgcagcaggccgcctcttcaattaaatgcctgtcataacacggaacctccagctcctttgctaaaagctcaccgattcgcctgcctccgctgccaaattcccttcctatggaaataatgattttattcatctttattcctcctaaacaacattcaatatgttaattgacatttgtttatttataagctataatgcattatactaactcgtggagatttatacaataatcattttttcattcccaatctaataaacaacacttttgtcttatatgttcattaacaataatttttgtgcaaaatagacaaaaagggacaattgttaaattcccgttaagaaacatttttaaaaaggagaaacgtcatgaaagaagagaaaaaagaagaaactattgaccggcggatcaggaaaacacgccggctcttaagagaatgcctgaccgcccttctgaaggaaaaaaaggttcaggatattacggtaagggaaattgccgatatggcagacatcaatcgtggaaccttttacctgcattataaagatgtctttgacttgatggaacagattgagaatgagttgttaaaagaactggaagatatgctgaaccaccaccaggctcaggatttgttatcccggccttccctgatatttgccgagctatatccccttgtgcaggataatgccgacattgtctcgattctgataggcgaaaacggcgacttgaattttgtcaaccgtttaaagcacatcgtgcgtgaaaaatgtctgaaagactggatggcgctgaaaccgctgcgtaattcgaacgcttttgaagcttactatgcttttattgtttccggatgtattggaatggttcagtactggttaagttccggaatgaaggaaagtgcggaggagcttgcttatatgacggagaatattatattaaatgggatacgggtgctggagaaggaagcaaaatagatttaacgatatcctgtacgctccgcgcacaggtcaccgccttcaattaaacagatggggccgccggggctcggccccgtccaccggcctgcggccgctgattgttaaccctggaacggaagacacagtcaaccgttctcatcacaccgtctccggtccgttccggacgcgttctccattctcaactcccgcctcatatggatccgaaacaattttatccccttccgacagcccgtcaagaatttccgttctcccgttttccgtccgtcccgctttaacggcaaccgcttctgctttcccattcttatctctgtaaacgattgctctttttccatccggaacaattgcggagacgggaactgtcagcacatccttcgctttgattatccggaaggtgacatccgcctgctgtccggcgccgaacccggtattaaaaatacccgattccactccttgcattgcctcttcccatggttccagctccacctggcagcggctttcttcaagtcctgtggaggacagctccttcgacgccgtcctggcgacaaaggtcacctgcacctggccttttgtcccgtcgggatacactgcctctgccacagttccgggtacaatgcccgagacgtcttctgcaagcacagaggccgacagcttcattccatcatcacggtaaatcttgacagccgcctgattctgagccagaaacgctcccctttccgtatagacttcccataatatgccatcgtaaggcatgcggatttccgcgcctccgaccgcctcattcagtgtattaagctgtctttcgcaggaagcgatctgttctatcatataatctctctgacgttcggaatttatctcccctgcctgaagatactgctgatgcgcctgtaccatctccagctcaagcatctccagctctgtccgggagagatagccgtcatccgccaggaccttaccggcctcgtagtttttctttgataaacggtaacttcgatctgccgcttcgtaagaggacgccgcttctccgtttgtaccgtataaccggtcatattcctgcttagccaaacttaactgctgctttagctgctctttttggatatccgtactgatttccagtaccgtctctgtccttaggaggacttctcccgcccttacctggcttcccggtttaaaagggacatccgacacactccctgctgccggggcgcctaatatcatactgtgaacaggcgtcaactctgcctggacggtaaagctcttttccaggttcccatatctgaccacttccattttagccgtgaccggcttaaacagcgaaatcccaaatacagcgaggcagataaccacaatcaatgccgccagtatttttttgtatttctttttcatatagccgccctccatttattcttcgctgcagcttcgccgtcctctattcgcgctccctcagaaattctgccgggagtatttttttaagcttccggtgcagtgccgcggaacccagaagcgcggagcatgcggtgaggcctgccgcagcgagcagcgcatttgcatccagcactttgggaattgtgtacatgtcgcaggacattgtggctgatatcaggcggctggccagatatgacagcgggattccaagaatgacagagcccgccgccagtacccattgtcctgccgacaatacatccaggcattctttgctgtttaaccccaggagcatgagaacggaaagctcccgtttcagctcctcataccggatcagagagctgacataaatcaccgcaaatccaattgccagtcccatcagagacatggaaaacataatcccgctcatactgttcatgacggcccggtactgggaggccctctcctgcctgctctgaatcagggagacagctccttttccctgcagttgctgccgaaggtttttaagaacaccgcgggaggcttttaggtaaacgccggtaaaaccgtctttataagcgctcacggccgccgccccctgataagatgcgtaggcatagctgcccatatactgcgctataatatcagtgacaactgcttctgtctctttcttttccgggtaagcagtgcgtatctctacggaacctccccgtttgactcccagctttcctgccatatgttccgaaaggacgattccttcttcttttacttttacacgctgtccgtccgaacggtacagatgaatcagctccgtatccatatcaattccctggagggtacagtcaacttttccctgcgggcctgccaatgtaaccggaaactcaatgattccctcagaaatcaggattccgggatcccggaccgcttccaacgcgtcgagacggctgaccggatggctgaaatataccataatgtcctgcttttgtgtcttttcccagtaatcaatgataaaaacatcaaacaacgcattcatcgatacgagagtcgccgtaatcatatacgcggctgccatacccgccagggaaaaacaggttctcctgggatttctggccagacttctgagtcccatcagtcccggtattgtaagtatctttacaacaccgggaattttttccagaaaagaatttctcacagcgccgggggcagccggacgcagcgccctggcaggctccgtcttccacatggcgcctgcgctaatccatgagacagacgcgcaaaagacggcagcgccaaatgttcccgtcagcatatatgcggccgacagaggcgctgtgacggacggcagcttgaaatacacccggtaataatctgccatcggatccgccagtatatatccgagcgccgttccgagaatgcctcctgccgcgccgataacggctccatataaaaggtagtggaaccgaatctgccatttcgaaattcccagggccatcatcgtaccgatctgtgtcctctgctgctccgtcatacggctcagtgtaatatataaaacgacagccgccaccgaaagaaagaggaagggaatcacgccggacattttttcaagctgtttgatttcctcaccgaccatggcggcgccggtctgatccgctccctcataaaccgaaatcagtccgtaggcctccagaagctgttccaccgcatcttccacacgctcccattccactccgctttccaagcgtatcagaaagctgttcgccctgttttccttccccagaagccgggcaatggtccggtaggaggcaaatgcagcatcataagtctccgggcttggtaacaattcattcctgtcgcggatcatatagatattttcaggtgttgtgccgattccggttatcttcatcgggaccttttttccagcaaccacaatcttaatggtgtctcccggtttcaggcctctggcattcgccatgctttcccccagtaccagctcctgctttccctccccaggcatcattcctcttgtgagcaggggccggttcatctggccctccgaccacgagacaaggtgcagctcagcctcgccctccacatcggccaattccacattctgcacgagacgcccttctgcagcggacactccgtccagcccttccagcctggacgccgcccggagatccgtatctgccgtatctgcaaaaccgtaacagtaatccgtattcctgaaaaatgtatccctggacagcaccatgttatcatagcaaagtcccagaacactgtatccgcacagaccgattgctacaatcaggatacaaagtatgtaggcagacagggaggtccggatatcacggagcatttttttgaataaaataactgccatatccgtccctccctcttaaaccgcccggctccgccaggccgcctgttcctgcccgcaccgccggcataaaaagacggcgcttaccagtccagttcctccgccgtgcatggcgcttcattgtcctctattcttatcagttctccgtctttcatatgaaatatacggtcagccacacgggccatctcgggattatgcgtgattgtcatcacaggacagttaagccgcttcctgacgtctaaaagcagctttacaaccgcaatgctgtttttactgtccagagcgcccgtcggctcatcgcagagaagcaaatccggtcttttgacaaccgcccttgcaacagaaacacgctgctgttccccaccggaaagctgagacggaaagtgacctgcccgctcctccagaccgaccatggcgagcgcctcatccgccttcatcgcacttttcacaagtgacgccgccagttccacattctccctggccgtaagcgacggaatcagattaaagaactgaaatacaaagccgactacatcacgccggtaaagcgcaagctgatccagcgtcttatccgtcacattctgattaccgtaccacatcgctccggaggttgggcggtccatacctccgactatattcagaagtgtggatttaccggaaccggaaggccccagcaccacgataaattctccgcgcctgatttgaaaggaaacatttttcagggcgttcacgattacatcccccgtctcgtaacgcatggagagcttttcggcattcagaatcacttccccgcacggttcaccatcactgctattcttttttataagcaatctgcttaaaccacctttcccatatgtaaaagtttcgcatcatatcctccaaacaagcggctttccccttctctgactgtcatggatatacacatcggtaatccatgtgagcaattcttcattagaccattagggaaattgactaaatcgttacagttcagccttcggctaaaaaaacagcgaaaacacctcgaggaatacatcatggctgaactgttacactaaatcagtcaatttaattgtatcgcattgactgatttttacaaggggaaggagaaattttctcagatatttctctgcatgatgagcgtctgctaagttactgttcacacggttgtgtcatttagttaagcaggtgaggacgccgccgctggcctgcggccgctgattgtctcacgcgttaagtgcggagggcggaccttgtccggtgtgcgaaaacctccgcctgagtcttccgtccccggcgataacctgacccggggaagtaggcggaatcaattctggaggggatatggaagcccatccgtgcttaacgataacctgtacgctctgcgcacaggtcaccgccttcaatgaggtttctcacgaatttagcacggctatgcgcttcgaaaagtgcaaacggtccccgtaagaattcattccggccggattcccacctcacgacaaccttcaaccaaggacggaagactcagccatccccctcaccacaccgctttctggcgacgcgtgaacagtaacgctgctcatactgcggacacccggacggatagttcacatattgaaaaatggcctgttctaagttataataaatgggcggcagaaaatgatgccgccgaaggcggtaacctgttcgcagagcgttcaggttatcgttatctgaagataacattaccttaaatgcagcatattcaaatgaacagggaagggaatctgactatgataagtgattacaggaacaaatttgttactccggaaatagctgccgccaaggcagtccaatccggtgactgggtggactacggttttggcgccggctttccggagctgatggacaaggcgcttgcaggacgcaaaggggaattgaaagatgtgaaaatccgcggcggcctggtaatccgcccccgaattgaagtcgtggaatgcgaccctgagcagtcctctttttcatattacagctggcatatcggggactatgagaggaagctgcaaagccgtggattatgccagtttatcccgatgattctccgttcactgccggagctttaccgtaagcatatccgcgtcgatgtggcttttgttccggtatcgacccccgatgacaatggctactgcggcctgggtatctccaattatgcatggagaactattttcgaaaatgcacgtaccgttgtgtttgagattaatgagcatctgccgaaacttcacggggtggacggctcccaccgggtgcatttgtcggaggctgactttattgtggagggcgaacacgaaccgcttcctctgcgcacttaccgggaaccctcccctattgatgtggaaatcgccagacatgtggtaaaggagattcccgacggcgcagtcttgtccctcggcgtgggcggtgttcctttcacagttgcaaagatgctggcggaatcggatcttaaagatctcggctgccatacggggaccatcagcgacgcgtttctggcgctctatagagccgggaagctgacgaacagactgaaagaaattgatacaggatattctacctggaaccttgccatgggttcacaggagctttataactggcttgatgaggaaccgatgctcttccgcccggctgatgtggattacgtccactctcctgagcgtatcagcaggatgaaacgggtaatcagtatcaacggcggtgtggaactggatctgatgggccaggagaatgcggaatcagcgggcagccgccagctctccggcacaggcggacagctcgatttcctggagggagccttccgctctgagggcgggaagggctttatctgccttgcttccacgcataaaaagaaggatggaacacttaaatcgaatattgtgccgtttgttccgggcggcagcgtggtatcggctccacggagtatgattcagtatgtggcaacggaatttggggttgcgaagctgtcgggactgtctttacgggaacgggcagaggcgatgatatcgattgcgcatccggatttccgggaggaacttgggaggtatgcgcgggagaattttggatgagctgatgtcatagttcgaatcgcttactgacaatatctttataaaataaatactcaaatttagtggaaaaaagccgcttaatcaaatatcaagcggctttttccatcttctgcctatcacattaccttcattttcaacgagataactcccgacaaaccggctataataatactaaaaataaaaaccaaattaactactgatttaactactgatacatcaaataagaaagcgaggctccctccatgacatctaaaaccactcctcctcttcgggaaatctatttcgcaggcggctgtttctggggcgttgaagaatatttttcacgcattcccggtgtttatgacagcatttccggttatgcgaacggcaacattccaaatcccacctatgaagaggtctgtaccggcacgaccggttttgcagagactgtccgggttatctatgagccggatattgttacgcttcgcatactgacggagcagtattttaaaattattaatccggtcagtatcaaccggcagggtaatgacaggggcagccagtacagaaccggtatcttttacgcaaatgaagaggataccgcagccattcagcctgtaatgcaggccatacagaaaaaattttccgagccattggccgtagaactggcaccaatcaggaatttttatccggctgaaagctatcaccaggactacctgaaattgaatccaaacggatactgccatattgatttcagcacacttcatgatttaacaacacggccggacgggaaagtaggccttcggcttgccggtgaagaattgaaaaatacattgactgaggaacaatataacgtgacacagaactctgccactgaaaagccttttaccgggaaatattatgataaccatgaacccggcctttatgttgatattgttaccggtgaaccgctctttatttcttccgacaaatttgattccggctgcggctggcccagttttacaaaaccggtggacagcagcgccgtgacagaacacattgataccggctacggcatgagacgtactgaggtgcgcagccgcgagggagattcccatcttggccacgttttcacggacggcccaaaagaatccggcggtcttagatactgcatcaacagcgcctctctccgcttcataccggccggacagatgagggaggaaggttatggagcttatctctccctgctcaattcctaaataataactctatctacgtcaggtgtgcgtctgagaagctaaccgcagggtccgctgcgccgccgcttctcaggcgcaaaactgcatttttccagtttctgtgcatcgcatgcagcggttcgcaaaaacagcgtttttagcaggaccgtgaataccgggaatagtaactgcttacatgttctactgttctttcatccactcaaacaggcttatctgccgtcccattcctgcttcctgctgtttcagccttcccgcctcttcccgctccaaacaagtctcgggcaggacgtttagaaactccgactgctctctgtccgtcaccagaatcaactgctccttagccctggtcattcccacataaaacaatctccgttcttcctctttgtccttttcccccgactgcccctttgtctccagaggaatcagcccttttctgaccccgcacagaatcaccacgggaaactccagtcctttggaggcatgcatcgtcattaaagtaaccgcatctgaacggtactgttttttgccgggccgaatcaaatctccctctgtgccaaaggcaagtgcatcggtaaattctttcatattgcggtacatgccggaaagctgcctcagcttttccatattctgattatccaggttctgatcggcaatccatttatccagaatgtcataaggtttttcttttatcatcagtagagaatacgtttttgcggctctttcaaatgccgcttcccgctccggaccatccatcccgttccagagaaggcgttggcaaagctttgccaaaaagcgctcctccccgtttaacaggcttctgaaaaagctgacacttcctctgacagccgtatcagccagaaaatcatcccggccggcaacgcggtagggtatcccttctttccttaggcatgtctccaaaaatgccgcctgacggtgtgtacggtaaagcactgcaatatctgaaaaaccggataaacgccctgtaacccgtttttcctgcgcatccagcatatcgatgccgccaatgagccggttgatttcttttgcggtaaatattgcctccgcccttacactttctgccgtaaccaggcggatgggacttccctctgtacacacaggttccagtttccacctctgacccggatttactgagatgactgcctgcgccccctcaaggattgctggtacggaacggtagtttttattaagggtaatctcctttaaggagggatactcttttttcaggtattcaaagcaggccgggtccgttccccgaaacccgtagatggcctgatccggatcccctatgacaaaaagctccctgcccccggaattccaaagtctgataagctcaaactggacgggattgacatcctggaattcatccaccagaaggtaatggaaccggcgcctgccgatttctttctttggctctgacttaaaaagtttcagagtctcaagcagcaaatcgtcaaaatcacatactccctctgccagtaaccgtttctgatactcagaagccgctttgtgaaaaacagtattctcatccgtatctttcccggcgcctgatggctccatccccgatttttccagagataaacgcctcaaaaatccagacggactctccggcaatccatattcctttataatttccccggctgtctcaaggagcatctcttcctgcgccggaatgcattcaaaatcactatcttttaatatttccaggcagatagaatgaaatgtaccgatattcaggagacgtactgtcttttttcctcctgtctgcttctccagacgctgtctcagctccgccgccgctttatttgtaaatgtcaccgccgtaatctctgaaggttttacacctctttctttgagcaagtgcagaattctcgcagtcagtgttcccgtcttacccgttcccggaccggctttaaccgagactgcccgggccaaaacggtaactgcctctttctggttttcattcaggaatatttccccaggaaggtcatgcctctctattatgattccttccggttccttcgatgcagccgcctctgtgacagacgcatccggcgtttctgccttacgaaaaatttccgtcggaatctcttcgatcacaatatcctgagacggcaaagccaggctgatctgcccgtccacattatcaagttcccacggttcaaacaactgaatcgtcccgtactctccgtcaaatcccggctttcgctttacttccccgcggcgcagccggctgatgccctccgctatcattgtccctgccgtcagcctgatatcctccgcaggtacatttctcaagatggaaaactcatctcccagacgtcggatcatttcctggtacatccgctggactctcacaccggcagccgattttccggtagacgcggcgattacctccgggaggggcacaagactttcaaacacttttccatccggcctgagatacccttccgcccgatcagccagctcttccacacggtgcgatacgcctatcgtcagtttttttccacagaccgggcattttccgtcaaacttccgggcctcagccggactgagacaaagatggcacttgcggtgcccgtcgaaatgatattttccttcctccggaaagaattcaattgttccctgaaggccctcgcccgtctcaatcgctttctttagtgccggataggacagctccccctcgatcagattggcctcccgccccagtttggcaggcgaatgagcatcggaattggagataagctgataggaatcgagagccgatagtctccagttcataggcggatcagaggaaagtcctgtctccagagcatgaatatgaggcgttaaatccacaaagcattcctggattgtatcaaagccggagaacgctccgaataatgaaaaatgaggcgtccagatatgcgcaggaatatagacggcttctggacaaagctccagcataatctcaaggagatcatggcagggcagtcccagtatgggcctaccgtcggaatggatattccctatttgttcaagcctcagtgacagccgctctgcatcctcgagaccgggaagcagaagcaggctgtgaacctttctaaccctctctccctgcttatatatggaactgatttctcctgttaccacaaatcgtggagtacccgaatcgtctgtgagcggatcgcgtacccggtattcctcctttaacatgtacaggccctcctctgcagggaccagcttttccttcagttcttccctccatgccggatgagtgaaatctccggttcccaatagccggattcccttttttctcgcccacagttccagaatttcaggcgtgcagtcacggcttgtggctctggaatagcgggaatgaatgtgtaaatctgctatgtacattctgtttctcctttatgtgtctgtaatatttcatttgccgtaagcatccagtttgcaatataactataaacagtataacacaaaatcacttcgggccattctattttttcccctgtttacatattttgatttgaggtgtttatatgcaatcctgtgaatttgccatgaccataaccgctctggcctgcaatcttgcccagggcaaaactccggatgagatcgccctctatgccgcttttttctcccagcttggagacactctggcaaccattgccgctcaccaggaattttgtgctcccaaggactccgcatccccaaccgcagatgtttccgagtcaatttagaaaatacgccggactgccggaaatggaaacctccatatccgacagcccggcgtatttttctgtagtttatctcatgattcagcttacgctttatattccatcggtgcctgcctcaagccgtttgctgcctgttccgtatcattcttcatggcaaactcatttttatttcttaagctgggtaagcctttcctgcacctgcgccatcatctgggtatatttctccagctttgaccgttcctccgcaatcttcgcctccggagctttgcttacaaacttttcattactcagcattcctgtaacgcgtgacaactccttagcaagcttttcttcctctttttccagacgttcaatctctttatcaagatccaccagctctgcaaacggcatataaattgctgcctgggaagttactgccgataccgcatcgtctgcaatcccggccttatccttctgaagcgccacttcacctgcatatcccaatgttgcaaagaaaacccggctatgctcaaaaatgcccagaatctcttcgttatcggacacaacatatactttcgcctttttgctcggcggcacattcatggaagtgcggacattacggattgctcgtaccgcctccttgataacctcgacggccttttcttctccggcaaagttccactctcctttgtaaaccggccaggaggaaatcatgatggacggttcctcatcctgaaggttacagaagatttcctctgtgataaacggcatataaggatggaggagcttcagcgagttaatcaggacggtcttaagtgtccacagagccgccgcttttgtcgtgtcgttgtcatcccagagccttggttttaccatctcgatataccagtcgcagaactcctcccagataaaatcatacaccttctggagagcgattcccagctcatatctgtccatattttccgtcacgtcttttgccagtgtatttactttggacaaaatccagcgatccgccattgttaagtccgagagactgacatcggcatccggcgctttttcaatattcatcatgatgaaacgtgtggcattccatactttattggcaaagttccggctggcctcgactctctcccagtagaaacgcatatcattgcccggtgcatttccggtcatcagggtcatacggagagcatctgcgccgtacttatcaattacctccagcgggtcgatgccgttgccgagtgatttactcatcttacgtccctgggaatcccttaccaggccgtgaatcaatacggtatggaacggttcttttcccgtctgttcaagtcctgaaaataccatacggattacccagaagaaaatgatatcgtatcctgttaccagcacatccgtcggatagaaatactcaaactccggtgttttctcaggccagccgagggtcgagaagggccacagcgcggaagaaaaccaggtgtcaagcgtatcttcatcctgatgtaaatgggtgctgccgcatttcgggcagactgccggcgttgtcttcgccaccgtcatctcgccgcattcctcacagtaataggccggaatccggtgtccccaccagagctgtctggagatacaccagtcgcggatcccctccagccagtggagatatgtctttccaaagctctccggaacaaatttgagacgtcctgactgcaatgcctcaatggccggtttcgccatctcgtccatcttcacaaaccactgcggttttaccatcggctctaccgtcgtgccgcagcggtcatgggttcctacattatgtgcatggggaaccactttaacgagaagtccctgggcctctaaatcagccacgattgcttttctggcttcgtaacggtccatgcccttgtattttccgggagcgctgattgtcgcatcatcattcatgatgcagatctcttccaggttatggcgtttacccacctcaaaatcgttcggatcgtgagccggcgttattttaacacagcctgttccaaaatccttgtctacatactcatccgccacaaccgggatttcacggccggtcagcggcaatttcagcatctttccaatcagttccttatatctgtcatcctccgggtttaccgcaactgcagtatcgcccagcatcgtctccggacgtgtggttgcaatttctacaaaccggtcctcctccccgacaatcggataattgatatgccagaaaaatccgtcctgctcctcatgctctacttcggcatcggagatggaagtctggcagattggacaccagttgataattctggagcctttgtaaatatatcctttttcatagagctttgtaaatacttccagcacggcatcggagcatccctcatccatggtaaaacgctctctgtcccagtctgcagaggaacctaatttatggagctgcttaacgatacggctgccgtaatcctctttccactcccatgccttctccaggaatttatcgcgtcccagatcatgcttgtctattccctcgctcttcagcttatcaataactttaacctctgtggcgatggcggcgtgatccgttcccggctgccataatgcttcaaatccctgcattctcttgtagcggattaaaatatcctgcatcgtattatcgagagcatggcccatatggagctgtcctgtaatatttggcggcggcatcacgattgtaaacggctttttgtttttattaacctccgcatgaaaatatttgctgtccagccatttctggtagaggcgttcttcaatgtccgccggattataagtcttctcaagttctttcatgtgtatctccttttatttttattggcttttgttttactgccaatgatttatttctttttgattcgcaaagcgcatgtttaaataaatttaaaagattctatcacctgcatgatttcctgtttcagcttcaggtccggctcaccgtcctccgggaaggttgccgtaataagatacccgtcttccccgtccgataccagataaaggagctggttcatccggtaattcccggtgctgtcggtcattgtcatgccaagcccggccatttcaccgcttatctcacggatatccgttgtcctgatatccggatacgcctctctcaaagcgtctacataacttccggcaaaggtatctttaaaatctgaaatcatctcttttgtaattccgtctgccggggaaaaagaaatccggaccgtactgtcttttataaggcagagttcccacgcgtccccgcttttcccggactgccatctctcttcatctgccgaaacagtaaacttgccgtctccgcttaagcagactccgtttttaaaagttcccggttcctgggctgcagcctcttgttctgcctcgctcccacacgccgtgagcagtatagctattatcatgagcacagctatcacagtattcacaacggacgctttcaccattcctgtcgttctctccgtcatctgccgcctccctgaaggaataaacctgccactgtcaactgtggccgttcctgcatatcacatctgtttcctgacaatacggtactcatcatctgtctggtagtatggacattcaaaacgttgatttccaagaaatgacgccatctcatcttcgtccaaatccgcctcacagacataatagccataatcgtcatcatagacataattaccgcaggattcacagctctgcggcccatcctgtttcttcaagccgtcacctcctttacaaaagcgttccgtttaccgccgcagtgcgatactccgcggagcggtttttaattaacaggtgaactttcctgttaaacaagaaggaatcccgctcgcgggattctccgcctgcggcgggtcgcttcggcgacattgttccctaccgccgcagtgcgttcctccgcggagcggtttttaattaacagatgaactttcctgttaattaaaaaaaccccttgcataaacttatgcaaagggcgaaatatcttccgcggtaccacctggcttctgccgaattctctaaaccttccggcaatctcattcagtcctttaacggagactatccgtgattccctacttgcactctgctttggggcccccggctccaaagctaccttccatccacaccttccctgaacagcctctcaaccgttgagccgttctctctgtcggggttgtgtatgtactcctcttcttcacagccttttcttatatactatgtaatcatagtggtttttctcctgattgtcaagccggtgccgtatttttttacgcagctcctgtataaacagggtaacagttcagacaggccagcaaatctgctgcgctgaccttgcgaaaaggtagtggcagcagcttatttgaatggtaccccataccaattgccaaagtcctgttattttcagccattgcccgttccgctctcttccctgtcttcaccctccgcacttctctcttcatcgttcctggtatctgcttccctgtcatccaaacgtgtttccactaaatatctgggcctccgctttgtctccagatatatctttccgatatattctcccacgattccaatcgataataaaagcagaccgccgataaaccagatggaaaccatgatactggcccagccgcttaccgtatttcctctgtaaaaatccacaaccgcccagaccagaaaaccaatgctgacaaaaaaggacgcaatcccggcaaatgtaatcagcctgatcggttttatgctgagggaagtaattccctctattgcaaaagcaagcatcttgccgagaggatacttgctctctcctgccgccctctctttcctgtcataatatacaacgtcggaggggtatccgatcatcggcacgattccgcgaaggaacaaattgacttccgtaaattccttaagcccctttaaagccctgcggctcatcagcctgaaatccgcatgattataaaccgtattggcgcccagaaggttcattagcttataaaatccctccgcagtcagccgtttgaaagcggaatcggtcgtcctcttcttcctcaccccatagacaatatcgcagcctgctttaaaacgctcaatcatctgatcacaggcatccacatcatcctgcaaatccgcatccagagaaatcgcagcgtcgcagtgccgggctgcctcagaaagtcctgccagaagcgcattttgatgtccccggttgcggctcagcttaagtcccagaaagtaaccgtcttccctgttcagattttcaatcagtttccatgttccgtccctcgatccgtcatccaccagcagaatacggctttcctcaccgataacccccgcattaatcagcgtcaccagcttttttcccaaaataccggcagtcaaaggcagtacttcttcttcgttataacaaggcaccacaaaataaatgatcggtgcattttccattttctctcatctcctgctgtcttttttaaaacatactgctcattatatatgaaaacagattaaaaagaaaggggggacttacccgagtcgccgccatttatcaatgcttttctttgctgaaagccaaaggaaaattttactgcacccaaacaccattttcatccaccaaaaatccgtccggcgttgtgcctccggtaaagagtgagccattatcgtccacataataccacataccgttggtctccacccatctggtctttgccaggcctccgctgttccggaagaagtaccagatgccgtcgatctggttccagccggtcaccatctggctgtcgttattaaaatgatatatctcattattaatcatcatcgattcattccttgcatatgtaccgtccgccttgacaaactgccatatctggccgttctgtatccacttattggcgtctctggcgttggctccgggaccgccggccggggatgaaggcgctgtgcctcccggacctgtctgctgcccgctctgctgaccgccggccggattctgctcggcagccagatatgcaaagccgtaatcgagaagcgctttggtatcagtataatgtgtctgcttactcttcaggacgacggcaatgagcctctttccgtcccgctcagcacaggtgacgagtgtattgccggccagggatgtgtatcctgtctttccgcccacaattccctgataatattcaccattggcaggattcaccatcttatgccccatcgtcagttttctgaccgtgggaaccgaagccgtggccggaaaatcatagcttacggtggatgctatctggctcaacgtctgattctcaaacgccgcctttgcaatcagcgccatatccctggcagtcgtatagtgattcgaatcattcaatccattcggattgacaaaatgcgtattggtacatccaagggaagccgctttctgattcatcagatcggcaaagccgctgacgcttccggccacatgctcggccaggccattagccacttcattggcagatttcaataaaagggcgtacatacagtccttcacggagaacttgtccccggctttaattttcagtgtcactgcgcctgcctccaggtttgtaaccgcattctcggaaaatgtcaccgtatcatcaagactgctgcgttccagcaccagaagagccgtcataagctttgttatgctggcaggataaaaccttgtatctgcattctgctcaaataaaaaccggttattcaaagcatcgtagagtaccgccccctgggatgccacaaccggagtctccagagaacctgaagcagttccctgggaaggatttgtccctgccgtaccagttgtcccgttcccctgggatgttgtaacggttcctgaaagagccggaaggcgcgaagggctggatgagccggtctggctctgctgcgtctgctgcccctgccccggattttgccccgtctccaaccccggccccgcagaaggccccgtaacattagccgaaacagttgaaaccacagccatcgacatggctatccccagacaaagcgctgctttaaaattcttccatttattcatccgtaatactcctgtatctctcatttttataattgtcggtaatatttccgacttcattatagatattgaagccgttttcccatttcatactttaccattgtacagcattttcccatattacacaatcggatccgaaagttataattattacaattttattacagactaaatgcacgcccatcttgtaaaataccactgttgcataaaaagctttccttgtctttgatcagttattttaaccggacatatcagcacatatatcctgttaaaccggatataatcaagtcatatatatcttacaatcatatacaggtggtgatataatgtacgaagagctattttataaacgtttagttgaattacgtctgaataaaggcgtctcagcccgcgatatgagcctctccataggccagagcgcaggatatataaatgcacttgaaaataaaaaaggcatgcccagcctgaccgtccttttttacatctgtgaatatcttgatgtcactccctccgaatttttcgatgagggaaacggatatccctccgatctgaatgagattgtggaggatctgcgtcatctcaaccggtcctatctgcaaagcatcggttcaatcataaaagggctgcgcagatgaattagtatccactaatttcttctgcagctgcccttcttgttgtagtagcttcctcattatcccagcttgcagacgtccacccacatctcatagcctgagcactgttccagttcttccatcgtcagttctattgcactgttgctgctaccgcaggccggaaatacagtcgcaaaccgcttcatggattcatccagatagaccttcaccccttcattaatgccaaacgggcatacaccgcccacggtgtgccccactttttccgccacttcatcaggggagagcatctttgctttaaccgcaaactgctccttgtacttatggttgtctattttcgcatcgcccgccgtgacaatcagtatcggttcttctccgattttgaatgacaatgtctttgcgattctggccggctcacagccaacggcctgtgcagccagttccaccgtggcgctggatgtctcaaactccagtaccctgtcatccatgccccattttttcatatgttcttttgcccgttcaatcgacattcccgtctcctcctgcttaaattgccgaatccgtcgataacgtttcacggacccggcaatgaattttataaatattttcttcttagttccgctgcgctctccgcaacaaggtatcccggtgcaatatcaaatacggtcttgcagccgctctgtccctctgcgttcatcctgtaagccgcccgcgcgtaagaaacgataatggaggatgtaaattccggattcgaatccagcttcaggctgtactctatcacatggccgttctctttattccatcctgtttttccacccctgagcacaaatcccccgtgaggcagacgggtgtgatctctcttcatctcctcctccgttataaaatgtacggtcgtatcgtaatccgagaaataatttggcattgtcttgatttcattctctatttttgccttgtcagcgccttcttccgccacgacaaagcattctcttgtgtgcttctgccttgtggtcagttcaggatttttgccgcttctcacttcctccagtgcgctctccaccggaattgtatactgtctggcatcctttacaccctccagccttctgattgcgtcggaatgtccctggcttacgcctttgccccagaatgtgtaattctcaccctccggcagagcagccatcgcatatacacgtgcaattgagaacatgccaggatcccagccggccgatatcaccgctacttttccgccctttttcgcagtctcatccacagcttcaaaatgctccggaattttcgcgtgagtgtcaaaactgtctaccacattaaaccactgggaatacttcggcgtctgtgccggaagatcagtcgcgcttcccccgcagagaatcagaacatcgatctcatccttcatcttttccgcttcatccgccaaaagcaccggaactccttttgtcaggatttccactgtttccggagcacgcctcgtaaaaacggcctttaattccatatccggattctgtttcagtgcgcactccactcctcttcccagattgccatagcctaaaataccgattcttatgctcatttttctttcctccgtctgtaaatgattgccaaaagggcataaaaagggagtgattcctcactccctcgtcagttgttccctattatactataaaaacataaatttttccagatctattctttatattctttccactcgtttcccttacaaaccttttactgcctgtttctgcgcctgataccatgtaagaagcagcggctcaatcctcctgttccagattgtcaaacaaatcgcaggaataaaattcccggatcgacatgttaaagccttcagctattttctgaatgttgacaatgcccggatttttgctgcgtccattgagaatacatttcagcgtcgaaagcggcatacccgtcttatacgacagtgcatataaagtgagccggtcccttttgagaagctccctgatacgtttcacagtcgcctcacatatctgcatcttatgacctccaatctttcgtatgaatctagtttatacgaaaaattggaaaaagcagggcgataaatcatactgaatgtaaggttctggaaattttttccattttttactataaggcggcaattgaccattgccggtcattgtcagcaatcggattttcgtcatcaatccagttcactcaggcctgtataaaggttgtaatatcgacctttctgacgtatcagctcctcgtgatctcctctttcaataattctcccgtgttccagaaccatgattgcatcggcattgcgtactgtggaaagccggtgcgcaattaccagtgtcgttctgtccttcatcagacggtccataccgtgttcgatgtgcttctccgttctggtatcgacggagctggtggcttcgtccagaatgaggattggagccttggacacagccgccctggctatgttgagaagttgcctctgcccctggctcaggttagcgccgtccccttccagcatcgtgtcatagcccttcggaagccgcattataaatgagtgggccgatgccgttttggcggcctgaattacctcttcgtcggctgcatccagacggccatagcgtatattttccatcacggtgccggtgaacaaatgggtgtcctgtaataccattgcgatgttgcgccgcagttcattacgtctgatatggcgtacgtcggttccgtccaccgttatcgttcctgactgtatatcataaaaacggttaatcaggttggtaatcgtcgttttaccggccccggtggagccgacaaatgcaatcttctgtcccggcttcgcatagaggctgatatcattcaggatcactttatccgcgtcatatccaaatgtcacatggtcaaggaccacctccccgctcaccggctccaccgataccgcttccgtatcatctgccggttcaggctccgtatccatcacggcaaacacacgctccgctccggcaagggctgaaaacacattgctgatctgcatggatatttcattgatcggccttgaaaactgtcttgaaaagtttaaaaataccgtcaggcctccgacgtcaaaattcctgaacacacagagcaggcctccgatgcaggcggtcagggcataattgacctggctcaggtttcccataaccgggcccatgatgcctccaaagaactgggctttaatctgtttatccctcaaatcgccgtttaaatagccaaactcttcctccgccacttcctcatggcagaatacctttacaaccttctgtccctgaattgtctcctcaatatacccattgagcgcgcccagggccgactgctgggccgagaaatacttctggctcctgccggccacaaagcctcccgctttcatcatcagcggtatcataacaacggtaatcacagtcaggtaaatattcgtataaatcatcaaaaccagcgtccctatgatactgagcgctccggaaaacaactgaaccagcgtactgctgagcatgtttccgatagtatccacatcatttgtaaaacggctcatcaaatcgccgttattattagtatcataaaagcgaagaggaagcttctgcatctttgcgaacagctcctccctgatccgctgcagcgcattctgcgctatcgtcagcataatcctggactgcgtataattggcagccacgctgagcagataaatcccagccatcacgattaacgccctgaacagacccgcgctgtcacctctgctcccgtccaggggcacgatataggtattgatgatcgggcgcagcatatatgagcctgccaggttagtgagtgtactcacaatgacgcagagaaaggccgcccccatccacattttatctttttcaaggtaagacagcaatctcttcaccgtctccttgctgttctttggtttgccgcctcccctggccgccattctgccgggtccgtgtttcttcctcggtgaatcggcaacacggttgccgtaacgccttttgaggctctctattctgttctgatccatcatgccagcacctcctgtccgtccttcgctcccgctgctgcctgcggcgcattgccgccgtcctcttcgtccccgctgttcctgccgtattgggtttcatatatttccctgtatgcctcacaggaaccgagcagctcattatgagtgcccataccgataattttgccgtcatcgaggacaattatcttatccgcatcctcgaccgagctgattctctgggctataatgaattttgtcgtgtccttcaaagacgtacggaatgcttttcgtatctgcgcttccgttgccgtatctacagcgctggtgctgtcgtccagaatcaggatccttggctttttgagaagcgccctggcgatacagagtctctgcttctgtcctcccgaaacattgactccgccctgtcccatctcagtatcgtatccatgaacaaacgaagtgacaaattcatcagcctgggcgctctttgccgcctctctgaccgtctccataccggcttcctcatcaccccattttaaattttcttcaatcgtgccggaaaacagtatgttcttctgcagtaccattccgactccttccctcagatttttcagggagtagtccctgacatcaatcccgtctatcagcacctgaccggatgtggcgtcatagagcctcggtatcaattgaaccagggatgtctttccgcttcctgtggaaccgatgattcccaccgtctctccgccgtttacctgaagattgatgtgttccagaacgtaatcaccggcctggccgtaagagaaacagacatctttgaactccacaccgccctttgtgacatgagcgtcttttctggccgcatccgtatccgtcaaatcaatttccgtatccattacctcattgattctctttactgaggccatggctcgggaactctgtaaaaacaccattgacagcatcatcagcgacatcagaatctgtactatatatgtggtaaatgccgtcaaatctccgacagccatgccgcctccgataataatatttccgccgtaccagaccacggcgactgtcgtcacattcatcgccagcatcattaccggcatcgtcgcaatgacaatccgcatggcttttaagctgctttccttcaggtcggcgttcatctccttaaattttttgcactcataatcttcccggacgaaagacttaactacccggacattcgtcagcacttcctgtattccgttattgaggcggtccagctttttctgcataatctcaaaccgcgggaatgccagcttcagtattgtcgcaatagccgcagtaagaagcggtattacaatcagaataattaccgccagccgggcattcatccaaaacgccataaacagcgctccaatcagcatccccggcgcgcggagcatcaaacgcagccccatcatcataacattctgtacctgctggatatcattcgtcagtctggtaacaagagaaccggtgctgaagtcatcaatatttttaaaggaaaactgctggaccctggaaaatacatcctttctcagatcgctggtaaagctgatcgatgctttggctgaaaaataggcgcccaggattcctcctgccgccatcagcacggtagttaaaagcatcacaagcccaatctttataatgtaaccggcatcccgctgagccactccattattgatgatcatcgacatcagtttcggcagcataatttccccgaacacttccgtcagcatcatgagcggcccaataataaaggcgctgcgatacggcctgacatatttcatatattttttcatattttattcctccaattattcctggtagtgtcaagtctgacactccgttttttattaaaaaccttgtattttcagggattacaccacttttgaaaataaaaaagcaatgacctccccttttctggtataatgagttcaccacaaaccatcacctaaaaaggataaatcattgcttatggataacattatactctatttactcactataattcaagaacaatacaaaactatctgctggctcctgaactttatctgcaaatatattccactcaagcagtgggcctttgatggttcccactcccctaaataccagaagtttactaccgaccccctcccgctcctcaagccgttcatcaaacaggactggcagtttctccttgaatactatctctggaagtacggcaaatccgtcagacccgttcagcgccgcaatggtaaatccatccctgaagataccttctgtcctctttgtggggcacctcaccactatctctacgataataatggcggcaatgggcagttccaatgcaaagtctgtgggcagacctttgtcaccggcgaggttgtcacatcgcctctccgctttgtatgcccttactgcggccactccctcgtccctaataaggaccggaagtttttccgcatccataaatgcgtcaaccccaggtgctccttctaccttcacaacctctccagggttgataaggaccatctgcatgaggattacggtaaaaacaagtataagctgcactacctctaccgggaattcacggtggatttcttccgcatggacttagactccctgcctgagaattcctcctccctgaagttttccaaacataacgctcatatcatgtccctgtgcctcaccatgcatgtgaacctccagctttccctccgtaaaacggctcaggctctgtatgacctttacggaatcaggatctcacatcagcaggtcgccaactatgccagaacggccgccattgtcattaaaccctttgttgaccactatgaatatccaaagtcctccgtctttacggcagatgagacttatatcaaagtccggggcatcaaaggctacatctggttcatcatggatgccgcttcccgctccatcctcggctaccaggtttcagacaaccgctctgtcgggccatgcatcctcgccatgcgcatggctttccggggcataaaaagactccccgagaagtttcggttcattgccgacggctatagtgcttatcctctggccgcccagcagttcgtaagggagttgggagacagcttccagtttgacattacccaggtaatcggactcacaaacaatgatgcggtctctaaggagttccgcccctacaagcagatgatcgaacggcttaaccgcacgtttaaatccacttaccgggtcagctgcggttacgacaattacaatggcgccaactataacgtggcgctctgggtcgcctactacaactttctccgtccccataagcacaaccactatcgggtgctcaatccagtcggtatgctggagggggctgacaacatgcccgggaagtggcagctcctgattctgctcggtcagcagaccatcctccagctgaaggaacagcaggctgccggttaaatctgttcttagattccgggccagaggtaaaaatgcagccatcccgaagggacctgcccttgatggcacgccaaaacaatgctatcatgctgtgacgcagacggtgaaatcttatctgttcctgagttcttcgccgtcggtaagacgttcagagcattgttttggtgtgccgtcaagggtggcggacactgccagtttctaaatatatctgtaatttacaaggttcatttacgccgggttccccggccatcggttttcataaatcacttgacactaccttattcctgccctgtctttatatcactttcctggaagagatattccaaattgaggcgcactttatccagatactcctcaaactgatccaactgctcatcagtaaaaccggcaaaaagagcattttccaccttcttaaatatcttttcgcttacctccacaaccgcctgccccttgggagtaatgcatatctgattgtagcggttatcatccttatccgtcacgcggctgatatatcctcccttttccatcttcttcagggagactgcaatcgttgccgtggacacatgctggcggttggctatttccttctgcgaggcgttgggaaactttgaaataaacatcaggatctgatgctggctccggtaaacgcctgatttgttcagctctctttccaggtacatcctgtgcagtttattagccataatatatttttctaccagtttctggttgcgtgtctccgaaccatcatgaaaattatcattcattctttttcctccttgttagctctctaataattaactatatgataattagttagttaacttatgtcaagttaaatttttatgaatacaattatgagccattgaagacggctgcagtctgtgataaagtatccttaacaatgtatgcttaaacagggaactattgacagagacgcgcaggatgcctgtcagatcgtataaagaacggcaattcaccggaatctgatgaaaaagaggggaaagaaaatgaagaaactgtttcataatgagtctttaaaaaaatatatccttatcagtatcatctgtacagcggttctggcggcggccagcgtgttcttttaccgccggcacaccctcgcgccggaacggacggtggagaaagtattagaaaatatcactgccggtattcccgcccagacttcggatctggatgaactgatcaagcaatttgaaacacaataccagccgtattttaccaatgaggcgtataaccaggcagtccaattgcggcagttcactgccttccacaatcagacccctgattttgaaggctctatcaatatctcttctccggaatttgaaactttggattcttctttgggggatatcagcctgtatggaacctttcaggttaacttaactcctgttgatgggacctcattcacacagaactggaatattcaagtccggctggttcaggaggacggcagatggctgatacgttatatgcggctgaaatttaataaagcaggtgaggacgccgccggtacggccagcggacggggtggcggggtgtgtatatgagtctttcgtcccggggggagattgtcgtggtttggggctgcgggcgaagataaagtctgcggagcacgctcccgctctgtgaaatgcatcgcgctgctaggctcgaaaagacctcgccaatcagcgatggatttcaacggcatccgcagactttatcttcccctccgccccaagggaaggttatcgccgtgacgaaagactccgccgggggggattggccccgtccgccggcctgcggccgctgattgtctcacgcgttaagtgtggggacggaccttgtcgctaccactcagtgctaccatgtacgaaacatacgatatgccttcgatgcgcctttttatagaattgcggaagatttgatatcagtctgccggaaatacgtagtggccgcgacagggccctccccatttaaggttggagacaatcagcgcccggaacggaccatgtccggtgtcgaaaacctccgcctgagtgttccgtccctggcgaaaaactgatccggggaagtaggcggaatcaattgcggaggggacatgggagtccgccggtgcttagcgaggtcttttcgagcttagcattccgatgcgcactccaaagagtgcaaacggtccccgcagcaatccattccggccggattcccccctcacgacaaccttcaaccggggacggaagactcagccatccccctcaccacaccggacatggtccgttccggacgcgtcctccgggcctcagttaaatatacgctgataaatactaaatcgcaccaaattgagcggaattaaccggtaatattcttccggccataattccgctcaatctgttttaacatcaaataaatgaaatttctaacaaatagacccagacaactactttatcccatatccaatatatatctgacgcatgaggatgcactgagtggccgcgacaaggtccgccccgcacttaacgcgtgagacattcagcggccgcaggcctgtggacggggccgatacccccggcggaagtctttcgtcccggcgaaccttcccttggggcggaggggaagataaagtctgcggatgccgttgaaatccatcgctgattactgtgaaactttaacttctgggaagccaaaaaagcgcagacttcccccatcaacctttttgacgtttattttgaactcagctaacaggttcaggcggcaactaccggaacctcccacccaagcgcttttaacttctttaggtacgcattaattttacgttccttgttgaattggttgtaataatcagcacccagatctttgaaaacaactccatccttgagtatgtgatagatggctataagcatggaatgggcaactgcaacataagcccgtttttttccacggtgggaactgattctcatgaactgcgcataaaagtacgaatttttatttcttgtagcggaatgcgcacagactaccagggttgaacgtaaaagagcattcccttttcgcatttttccggtcttcctcttttgggcactctcgttattgccgggacatagtcctgcccatgcagcaagatgaccggccgttggaaaacgactcatgtctgtaccaatcaccgaaataatggcctgggaactgttttttccgataccagttacatcctggattgcttgtgtcgctttttttttcttccggtttcataaagttatcaatctcatcttccagattgttgatatgaacattgagttcatccagatgggacagcagctctttcatcattcgacgttgtaatggggtcatgacaccatttaaatcatcgataagctgttccttgctggctttgagattgtgggcaatgattttctgtttatacatttcatcatactttgcttcgtcgaagaattctccggtgagaaggtattccagaatgttgcgcgcactcatgcagttgatgtcagatacagtaccggacagctttatgttggcaccctccagcatcttttggagtcggttcaattcccgggtgcgttcactcacgaggcttttccggtagcggaccagttcccttaactccctctgctgtttatccgggatataactggcttttaataatccgtgctgaagaagctccgcaatccattccgcatcctttgtatcggttttccgccccgggactgctttcatatggctggcattcaccaccatagcctttagttcagaagactcgaggatgttatacagaggcttccaataggacgctgtgctttccattgcgaccatttcacagccaccgttctgaagccagttagctaattcaagaagctctctggttgttgcaccaaagttccgtaactcctgcttgctgccttttctaaagcaggcgacgatgagctttttgtgcacgtcaataccacaacatttgtcgtaaactttatccatatggttacctccaaaataaaatttacggcacggtactctgtctattattattttactgtacgtccttctgccgcaagcggctggacagatggtggtgcaaatgagagtacctaaaatcagtttagcgaacgggctacaggcccaaattagtgccgatttttgccgttaatgtcagtataagctcaatcaacagcaatttcaatcacctgccgccctcgcagtttcatttatggtggtgccgcatcagaggcatgggggtttagcgaggtcctctcgagcttagcagcgcgatgcatttcacagagcgggagcgtgccccgcagactttatcttcgcccgcagccccataccacgacaatcctctcccaggacgaaagactcatatacacacccacgcccccgtccgccggccgtaccggcggcgtcctcacctgcttatttaaatctccaaaatctttatcaattcctccctgctcatctcagccaatgaaaccataccttccgtcacaatctgatccgccagattcttctttgcttcctgcaaattcagaatattctcctctatcgtatctttcataatcagcttataaaccgtcacctgcttctcctgcccaatacggtgggcgcggtctgtcgcctggttctgcgccgctacattccaccatggatcgtaatggattacgatatcggccgccgtcagattaagtcccgtccctccggccttcagggaaatcaggaataccggcacctgatcgcggtgaaacgcattaaccattttattccgctcctcctttgtggtggaaccggtaagaagatagaatggaattccttcttttttcagcctgttacctataattcccagcatcgaggcaaactgggagaataaaaggattttatggcctgattctgcagcagagagaagaagggagacgcaggtctcaagcttggccgactcaccgttataccgttcgaaacagagggacggatcacagcaaagctgcctgagtctcgtaagctctgcaagaatctgaaatttcccggacgtttcagccgtcttttcatcctcctcaaggctctggcggagttttaaggccgccgcacggtaaagctccttctgctttccttccggagccgaatagacaaccttttcgagcttcaccggcaattccttcaatacgtctgatttcagccttctcaggataaatgggcgaatcatcctgtggagattctcaagagcctctttatcctcctcttttacaatcggtatctcaaacatggttttgaacttgcggtaggtaaacaaaaagcccggcatcagataatcaaaaatgctccacaattcgctgagtctgttctccaccggcgttcccgtcagggcaaaccttgaaattgctttgactgctttgactgctttcgcactctgagtagatgcattcttgatatactgcgcctcatcaattatctcaaatcgaaacgtatgctccatataataaggcagatctcgtttcagaagatcgtaggaagtaaccacggcgtcatactcatcaatctgttcgagttccttctgccgttccgcctgcgggccggtcaccagcagtactctgagagaaggcgcaaaaatggaaaattcatgtccccagttataaatcagggaagccggacaaattaccagggaaaccgacggctgcgccatgcccgcggctgtaccgcaggcacgctcttccttttccgctgccagcagggttatcgtctgaagcgtttttcccaggcccatgtcgtctgcaaggatcccgccgaaccggtagccgtccaacatcttcatccagacaaaaccggccttctgatattcgcgcagaaccttcctctgttctgccggcggttcatacccgaccgtctcagatgactgcaaatccctgacaatcgttttaaacaagctgtctctggaaaatggaatatgcccattttctttgaccagactttccagataaaatgcccggtaagccggcaatgatatcattcctgactgcagctcattctttcccagcgccagaccgtcggtcagcttcaaaagggtcaaaagaccgtcgtcggtcagtctcagaaaatctccgtttttcatccggcagtacttctttttctgtttgtactccgaaagaatccgcattatctctgaggtattcatcccttccgcatccactttaagattcagccatccttcatgaaccgatacgcccagggatatttggggcggagccagaaccttcattgatttgacgctgtcggagacccatacctcccctgtttcaccgaaccggtcaatgccttcactcaggagacggtaaattgcatcctcatcgtcacgtatgacaagatattcaccgttatcttccctgtattcaaaatattttgtaatcaggcggctgacccggaattcttccggcacgtccctgcatatctccttcggtattttttcatcctccagcggatgaaaagaaaaatcaccataggagagaatcggcttcatcgtaatttctcccggctgtctgctgtcaaattcaaatctggcctgcaattctcccggcctgtaataatcccagtcaatccccccggactccaggattcctgacagatccagctttttcaggactctctcataaaaaagaggaatatcccgctcatttacgcttaccttccgcgctccccctggctcagacagtatctgtgtgagaaaaatagtcaggttttcagtgctctcatcatcacagcagtaaagatgggtttcatccgccacatagaggctcttctccccctgaaaaaccatcagttcgtccgggatcctgatctcaagcccttcccggccaatcctctgagcccggacacgaatggccggtttgccccgtaaaaatttaagccgcgttctgtgccccctgcaggtctccgtctcgatttccctgccctccacaattgcaaaaaaacggtcgcaggccgaacggctgagtaacagtgtattaagggccggtgccgcagcggctgtcctctttctgatatcctcataatgctctttataggcccccgtctcttccataaccatctgcaccagaggcctgctttcctctgaaaatgccaaaaggctgtgttcaaatgcaaagccctttccgtattcgactctttttcccgttctgaccgcgtcggcaaaagctcccaaatcctttatcagatactgcctctttcccctgatccggcattccagggaaactccgcggcggctgataatcaggcaggggacaaactccacaaccggggccgtttcctctcccatgatgcgtgcaacctcccggtttgtatattcacgtatcatagacctcaccgcaggggaggttgaaacgggaagcgcattcatttcctgctccctgagccggtactttttaaacagctcaagcccgtgttcacaaatccccttatatgaacttccgtaagggcaggaacagtgataatcataaatttcaccgtttttaataaaaatccttgttctgtatgagccttccccgtcttctgctactgcctggacccggacttctcctttccagaatgtgtctaccgtcatatccctgatgctcaagatgcccctccaatagctgtctgttccaatcggcaaaagcaagctccgaaggcttttcaccgtcaaaaaggcagctctccatattcagacaggcggctcccggaatggacagccgcctgtttcaaattcacttgattacatatgctccggagattccatccccagaagatccatacaggtgtccagaatctcttttgtcagcgtaatcagactgataaatgacgcctgcttacaggcatcctcctcagcaatgatcttattttccagatagaaattattgaatgcatccgcaaggtcggccatgtactggcaaatcttatgcggagcggtctctgcaaacgcggtttcaataatctcgccaaaacggcagagttccagctgaagctctttctccgatacggactgtgccggacggatcggctgccattcagcatctttgcctttcagctcctcatatttttccagaatcgatttaattcttacaatcatatactggatatggggaccggtattgccctcaaaggaaataaagcgctccacatcaaatacatagtctttcgtcgcctgattagagagatctccgtatttcagggccgcaaggccgataatctcagcggtgcgttccatctcattctccggaaccttctgtttttcctggatcttcttataaacttccccgttaatatccctgattaactgctccagacgcattactccgccgtcccttgtcttaaacggaccgccttccttgctgttcatcgtaccgaaaccgaggaaaatcatctgtgtatcttcttttactattcccgctttctttgcgacacggaatacctgaacaaaatgcagttcctgacgcttgtccactacgtagatataacgatccggctgatactctttctccctctcaataatggttgccagatcagaggttgcgtaaagtgaggcgccatccgatttcctgacaatacaggggggatattcttttgcgtcgccttcctgcgccacgtcaactacaagagcgccctcgctctcataggcaagacctttctcaatcaaatcgttaatcaggccgggaatatacggctgggcatcgctctcacctttccaaaggtcaaaataaactttcaggttgtcataattctttttcaaatcagccagtgagacattcatgatatggttccaaatggccctgtatggcttgtagccgttctgaagcttaaaggtggcctcctgagccctctccttgaacgcctcacctgcttctgtcttttccttcgcttttgcgctggctgtcggatagatctcctccagctctgatatcgtaaacggcgcttcctccgggtattctccctggaaagtctcatcaaaatagacaagctccggctgtctgtcgtgaagctcctcgatgatcaaacccatctgaagcccccaatcgcccagatgaacgtcgcctatggtcttgtgccccatataacggcagatacgtttaatgctctcgccgataacggcagccctgagatgccccacatgaagaggcttcgccacattggccccgccgtaatccacgataatcgtctccgggtcctttgcttcctcgagaccatacttctcatccgaggccatcctgttcacatatccggcaagatactccggattcaggcggatattgataaagccgggcataacggcattaatctcagaaaacatggaactgtctttcaactgctccaccagttcattcgctatatttatcggtttctttttgtaagctttggccgccgccatggcgccgttgcactggtattcacagagatccggccggttagacagggtcacacggataaatttttcgtcgtatccgcagccggtaaaagccggctttaattcctctatgatcaaatccactatctttttcatcaggttactctccttcttgtattgcctttgctttcggtacagccgtccattccgctgtctcttctgctttttctatgtttaagcgaactttaacgcatcgctttttttacatcttttttaaactgcttccaggctccctcatcctccgagaagttcttggggcatgcctttcccgttacatcatagtgacgtatcacatcctttgtggtcaggtccagctctttacaaagccatgctgtcagttttaccagggattcatacgtttcctcggtaaattctccgtcctcgccgggatggcagcattcaatcgaaatcgtatccgaattgcggttattggaagcaaacgacttctcgtctaccggtatacactggataatctctccatccataccaatgataaaattgctgctcaccgatgttgtattgctgccgctctggtttttcaggctttcaaaataatccctgttctgctgggctgtcgttcccgggttcccgatatagtgaacgacaatggagttcaccgccgccagcttggttcccggtctcgaatacggatttaccgttaaaaactgctggtcaatccactccggcgctttgatggcgctcaaatctatggccttccgaatcgttgtcccccttaacagccatccggttcccgttcccaggataaatgcaacaatgccgatgacacagcggataatgagtctcttgcggatcagctgcttccgcctttgctcctttgcaacggcagatcggcggctctctcttctctccctctccatccgttcttctcctctttcgtacttcgtacaaagtaaaaaagaactgctgtaaaatctcgctcgtctcctccggatattttacagcagctccattttccatatggtagccgttcagttaaactctattacactctggacagatactcacccgtacgtgtatcaatcttaatcttatcgccctgatctacgaataacggaacgtaaacggtagctcctgtctcaacgacagccggttttgtagctccctgagccgtatcacccttgaagccaggctcagtatcggtaatctccagttctacaaataacggaggctctacagagaatacattgccgttgtaggaacaaaccttgcacatttcattctctttgacaaatttgagagcatcaccgattgaatccggatttaatgcaacctgctcataagtgttcacatccatgaaatggaacagatcaccgtctgaatataaatactgcatgtccactctgtcgattcttgctgccgggaacttctctgtcggtctgaaagttctctctactacgccgccgctcattacatttttaattttagttctaacgaatgcagcacctttaccaggttttacatgctgaaattccataatctgaaaaacgttgccctcgatttccagtgtaataccgtttctaaaatcgcccgctgatatcataaatgatactcctccttaaattctctgttgatcttttttattttatactataataccctgtttttcaactactttttgacgattcacgtccatttgcgtctgaattgcgctgcaatccggccattaatcaactgccttcatataccggcgtgtctttttcaagtttttcaatcattttcacgacgtgtgaaatatcaattccgtcaacttccacagactgatgtgaactttccatgtaaatcggattacgcttttcaatcagctcctccaccttctgcctgacattgtctccctgaagcagcggcctggaggtgtcgcccttcagtctttttaatacggtgtcggcagacacgcgcagataaacgacgcggcccagctttttcagcagttccctgttctctttgcgcatcggaagtccgcctcctactgagagaatgaggcgttcttcttccttccccctctctgcaaccagctttttcagaagctccgtctccatgcggcggaaggtttcttcccctctctcggcaaagatgtcggaaatgcttgttcccgcttcctccctgatcagataatcggtatccaccatggtaagaccgtgtttcttcgcatacgcctcgccgacacatgtctttccggctcccataaaaccgatcaggatcaggttggccttccttgaggacgccagtctgctggctgcgagacgttcctctataatcgtcctcgcttctacaatcgtatcttcatcgaccttcacacccggattccacagttcataggagatcaccccctggtaaagcagcatattaagcccgtttactgcgcggccgccggctgcctccacattttccatgaactttgtctttgccggagtataaatcacgtcgactgcttcgctgattttctcataaaatgaaggatcctctatcggggctgctcctaccttcggatgcatccccacactggtggactggacggcaaaatatttgccttccgggattttatcgtgatcttccagcgccagaggcctgaccacatcccttcctgccagacggttcacccattccgtcaggtgcattgctttctccttactccggttcagcagatagataaccgaagctccctccttagccatcatataggctgccgcttttccggcgccgccggcgccgatcaggatgcaggctctgtctttgattactatgccctcctcttgaatggagcgaagcagaccgggaacatccgtattataccccttatatccgccttccatcctcaccagcgtattcacggcgccgatgtctgcggcagtttcgtctatgtcctttaaatatttcattaccgtctgtttgtggggaaccgttacgttgagtccaagtatattcagggcataagcgccctctaccgccgactgcagattctcttctttcactttatacggaacatacgccagattaactccggttctctttgcataatggttctgcaaaagcggtgacatactgtgttctaccggattggcaataatcccgcatattttagtttttccgtccatactatctcttcctcttctgaatttttcttttctctctattataaaaatacagcacaatccattccaggcggcgctttataacgatctgaatttcctctttcggatgaatcggcttaaccagtataccgtaaatacctgccctgttggctccgtagacatcggtaaagagctgatcgccgacaaaaagggtagtcgcctcatctgtcttcatcagctccattgctcttttataacctttaattcggggttttcctgctttgaacagataacgcgaagccacctgagcggcaaaggaggtcacccttggttctttattgttggacatcaggcatgtctccatccccatccccctcagtctctcaaaaagggccacagcccttgtatcagccggggccccatgcggtaccagggtattatcgatgtcaaaaatcactcctctgatccctctgccgtaaaattcttcataggggatatcataggccgaatccacatattctctgggataaaacgcattaaacatcaggctttccttccatccggtttattctggagaagtttacccagttcttccataaaggtgttgacatccttaaattcacggtatacagaggcgaatctgacataagccacctcatccaaatccttaagcttgtccatcaccagctcaccgatggccgatgtactgatttctttctcctccatattaaaaatcctgttctcaatagcatcaatcacagaggcaatctgctgcggagataccggccttttgtgacaggagtggagtacgcctgcctcgatcttggcccgatcatatacctccctcgaattatctttcttaattaccattaacgggatcgtttccagtttctcgtacgtggtaaaccgcttgccgcaagtctcgcactggcggcgacggcggatggaactgttgtcgtctgccggccgggagtcgattaccttcgtatccgctgcattacaaaatgggcatttcaaatatttttcctcctgacacgaataattgtgtttattttatcgcaacgggtcgggatatgcaagtgttttatccagaaaattaagcaggtgaggatgctgccggttactgttcacacggttatgtcccgcgaggtgttttcgtgcgttttctgcgcgaaaatcccgagttacacggcgcgaaactgcgtgttatgcagtttctgtgcatcgcgaagcgtgttattgtttacatcatgccgctttttggcatggtgtgaacagtaaccgctgccgggacggccagtggacggggtgtgtatgagtcttttgtcccggggaaggattgttgtgagttgggactgcggagaagatatagtctgcggagcacgttttcactccatggaatgcatagcggctgctagactcgaaaacacctcgtcaagcaccgatggattccaaaggcatccgcagactatatcttctcctccgccccaaaggcagactttcgccgggacgaaagactccgccagaggtatcggccccgtccactggcctgcggccgctaattgtctcacgcgttaagtgagggggcggaccttgtcgcggccactcagcgtttccatgtgcggggagcgtggcagcggcaaggttcccctcccattgagggtggagacaatcagcgtccggagcggaccggggccggtgtgcgaaaaccttcgcctgagtctttcgtccccggcgacaacctgcctggggaagtaggcggaatcaattgtgcaggggacatgggagttcgccggcgcttggcgaggtccctcacgagcttagcactccgttgcgcactccaaaagcgcgagcggtccccgtaacaattcattccggccggattcccccctcacgacaacctgcaatcagggacggaagactcagacagaccaccctcaccacaccggccccggtccgttccggacgcgtcctccattctcaattaaatctcattctttcttctccctcagctcaacaagaataatgtcgtcccctatctgtttgatgtcacaaaaaggaatcacatattctttttcatgtcctaaaaacccccagacacagcccggccccggaacgatgattgcaatcatcctccccgtacagatatcaaaatccacatctcctacaaaaccgaggcgtttacagtcctttatattgattacttctttttgcttcaggtcacagattctcattcttatggcctccggaaagttggttactgttaatatatgtgaaaatacggctttgtgttcctttgcctgtgcctttgccgcaagaaaaaccggatcggaaaaggcacgggattaccgtgcccttcaacattactatatgctattccctgttatcggaaatgtaaattgcggattccactccggccgtctcaccgaatacaacagtcgcagttaaatcatttcccggcagaacagcttcgccgtgtacgcctgcatcgatcagccctccgactgcatagattccgggaaccggctctccggccgcatccaggacttccgcgcatgaattgacaataatgcccgtagctttttcatcggctgctttagtgagctgaatctccattcctgataaaaccggaagcagatccttgtcggcagctacaacggcaatgctgtcgatggtctcttctgttccgtcaatttctgcctttactcctgtcacaacgccgtcggcatttatgacaatctctttcacctctgctcctgtctttaccggaatcttcagatcctccacttttttaaccagcgcttcggataatgcctctgaaagactgcctccgtctgccaatgtatagcttctcgccagagatgacccatccttcttttcgactcctgttaatttgattccgaggccttccacccagttcttggcttcctcagcgctctcaacaagaaattccgccatatcctggttgttgctgttcttaccggccttcaatgtatccgacaggaaagtgtcgtatgtatcgtcaatctctgcttcaaactgctcggccgtctccgacgcattgataaaatcttccttttccttcatatcggctgccagttcaccgctgccgctcagaatcagaatcttagacggattaatcccatcctccgccgcctggatggccgcaatcagccctgcgccgtttcctccgaggataacaagctctttcttctgctcttctgccgccgtctcagccgcagcctcggttgacggagcctccggtgccttcgttgtctcttcggttgacggtgatgttggtgcggtattattgctgcatcctgtcatcgctgccgcagccataactgctgctgaaaacagggcaagtgtttttttcttcatgtgatttgtctcctctctttgacagtcctgttaaggaatctgcttctctatgatacgttcaaaacaatcgtcccaatatagaggctgctgcttttaaccatatcagtactacagtctagcatagaatcggcggcaaatcaattgagctttttttaattctctgaggaaaaatggaattctttattaaatttctataaaaacaactctgccagctcaaaatggcagaagacgccatggaaaactttaccttaccgcaaaggcggcaaggcccaaagagcaatcgtctccgggccttgttccaaactctctatattcaataaccgccgaactaacggcacaaatccgtgataacctgggcaaatatcttggcgctcaccagcagctcgtcaatcacggcaaattcatccgccccgtgcatcctgttatccgtctccggcatagcagcgccaaaggcgacaccgttctttaaactgtgtacataggttcctccgcccatcgattcacaggttcccttacggcctgtatatctctcatatgccttcagcagcgttttgacaaaatcggaattaccgtccacataatgaggaggcgtcatcgtttcgttcgtcaatgtaaacccgtgttccgccagtctcctccgggcaggctccagcacattctcctcgtttgcacaaatcggacagcggctgtcaaaggttgcatccaggctgtcttcactcacctccagaagatcaaaggccagtgtaagcgcgccggaaagttcatcttccattgcaactcccagagcctcgcctgaagtgtcatgataaggaaacagctttacaaggctgtgaagcgcctcaatctgcgcacacggtgcaaaaggaaggcggctgatcaggagcagcagcgccgtcagggcgttctttccctcagtcggcagcgacgcatgggctccttcaccgattgctgttatctccagcgtatggtttctcccctgtatttcgaatgatacgcctgtctctttctccacttcggctccggtatcgcggacaagattatcatccaggccttcaaatacggcaaatgccttacccggaaccacattcgccttcgtaccggcttttattgcgatgactcttgcgacggcatctgacggttcaaattctgccgtaaaatgcccctgaaggctccccttttctatgttcacaacagggaaagagccgtccggtgaaaatgtcatcggggcttcttcctcaacgtcataataatggcggatatcggaactgccgcactcctcgtccgtccccagtatcagccggacatttttagacagcggaatccccagttcttttacagcgcgcatcgcatagagagccgcaaccgccggccccttgtcgtcggccgttccgcggccgtaaagcttcccgtccttctccaccggttcaaagggctccgttaccgtccatccctctccggccggaaccacatcgagatgggcaaggatatcgagctgcttttccttctcgttcaaatcggctgttcctacataattgtcgtaattattaatggaaaatccatatttctcggccatggacagcgccagggcgagtgccctgctggctccctcgccataaggttttccctcctgataagctgttttctcgctgttaattctgcacaggagactgatatcatcaatcatttcctgtctgtgggcgtcaatatattcttcgatatgcttcttgtacattgtctgtcctttccgctatttcagcaattctgccagaacctgattcacaactttgccgtcggccttgccctttaccttcggcatcaggactttcatgatttttcctttgtccgatggagccggcttttcaatgccaagttcggagagaacctcctttatcacctgggcaatctgttccccgctcatgtcttccggtgcaaaatccttataaacagccaggcgagcttctgcctccgcacggatatcgtccctgtccgccggagccagctcgtatgtctccctggtctgtttgatttcttttttcaccaccgcatcggcttcttcttccgtcagaggctcccgcttatctatctcagcattcttgagagcggaaagaagcatggaaagtgaatcttttctcgctttgtcctttgccttcatagcctctaccatcgctgcacgtacaacatcaatcttactcatcttcttacctcctgcgaaattttttttcagaaaaagttaagtctaaggctgtgtaatcgggggtttaattattgcggccgaattcgctcagcttaagacccggattgcgatccaggaccattccgacgctccagctgttaataaacagcagcagcggattatctctgagatctttaatcctcttcatatcggatgtaccctgaatctttgccacatccagctcatccttgttttcaatccagcggatatactcatagggcagtttatccagccttacctctacgttatattcattctccagcctgtaggtgagaacctcaaactgaagcacacccaccacgcccacgattatctcttccattccggtattaaattcctggaatatctggatagctccctcctgggcaatctggctgatgcctttgataaactgttttctcttcatcgtatccatctggcgcaccctggcaaaatgctccggcgcgaaggttgggatgccctcaaactcgactttatctgcccctgtacagagcgtgtctccgatcgagaaaattccgggatcaaatacgccgataatatctccggcatacgcctcctccacaatcttcctgtcctgggccatcatctgctgcggctgggacagacggatcttgcggccgccctgcacatggtttacctccattccggcctggaactttccggaacagatcctcatgaatgcaatacggtcacggtgcgctttgttcatattagcctggattttaaatacaaaggcgctgaaattattgtcaaacggatctacaataccggtcgtcgtctttctcggaagcggtgacgtcgtcatctgaagaaaatgcgtcaggaatgtctccacaccgaaattcgtaagggcggaaccgaagaaagcaggcgaaagcttgccctggcttaccagctccatgtcgaattcatcacttgcaccgtccagcagttcgatatcttccagcagctgctggtggtaatccggtccgattatgctgtccacatcttcgctctcaattccaaactcccgggcagccacttccttctgacctcccatggctgctgtaaaggtagtgatatttttcgcatttctgtcatagacgcctttaaaattctttccgcagccaatcggccagttgaccggacacgtttttattcccagaacgctctctatctcatccatcagctcaaacggatccctggcctcgcggtccatcttgttaataaacgtaaaaatcgggatattgcgcagaaggcagactttaaacagcttgatcgtctgcgcctcgacacccttagacgcatcgattaccataacggcggaatcggcagccatcagggttcggtacgtatcctccgagaagtcctgatggcccggtgtgtccaggatattgatgcagtatccgtcataattaaactgcagtaccgacgaggtgactgaaattcccctctccttctcgatctccatccagtcggaaacggcatgcttggccgcttttctccccttgaccgtacctgcaaggttgatcgcccctccgtaaagaaggaacttctcggtcagcgtcgtcttacctgcatcggggtgggaaatgatggcgaaggtacgccgtttttttatctgttctgttatattctccaagagtttttcctccaaaaacaataattcaatttattttgccatcgaaaaaatagacatctgtataagatgtccactttattctattatgaaatataaggaaagtcaacaaaaagtcttgacattatatccgccagccgatatttgcaaaggcgccaaaaaacaacttccaggcctcaaaacgattcaagccactttcgcgccagctccggccaaatctggcagcacggaacaatgtagctgcccctgccgtcatccgccgtcttatccgtctcctgcgctgcaagcgccaggccgtgcctgccttctgggaaaatatggagttccaggctgatcccggcttttttaagcgcccaggcaaatagaagggtgttctccaccggcactgttttgtccatgtccgtatgccatataaaaacgggaggaacctgttttccaacctgcttttcaagagacaggaactccctgtcaacggccgcagtcccgcagcctgtcaggttgtcaaaggatccgctgtgcccatattccccggacgagatgaccggataggcaagaatcagtcccgccgggcgtatatcttccttactaaggcccgtcttcatcaaaagaaaatcgctgtcccagaaaattcccagggatgccgccagatggccgcctgccgaaaaaccgcacagaaaaatcccctccggatcgacatgccattgctccgcatttctgcgtatcagcgatacggcagtggccagctcacagagggcctccgggaaaatgctgggcgacgtactgtaatgaagtacaaatgcctggcagtccatcgccagaaactgaaatgccgccggctccccttcacgggtggaacaaaactcataaccgcctcccgggcagataatgactgctttcctgcgtgcatccggctttccgtccgtattatctttcaaaaagcaggttaaaagggcctcgccgctgcgctttttgcagcttccctctttgcctttacctgccgcttctccggccggaacctccttaatccggattccggcgccgttacctcccgtcctgatcagatatttttttaataccatcttccacactcctgctcttaggccccggtctcaccgggttctgtaaattaccaccattgtacaccgcgcccagcgaacggtaaagcagaagttcagccgttcagttgagggcggcggcggacggggtgaaacggcatcttttccgtttctgtgcatcgcgaagcgtgttattgtccgcggaacgccgattttgggcttgaacagtaatcattcggaaagattcgctccgattcccctgtttgcatgattgtttttccatttaaaatattgtatactttcagtagtttcatatatagtatggattaattcattttaccgggttatttaaataagacgaaggagttttttgcatgattctggctatcgatatcggcaacacaaatatctttattggggcgatcgacaataaaaaaacgtattttgtagagcgcattacaactactattggcaaaacgaatctggaatatgccatcacactgaaaagtattctggaaatctatcagattgaaccaaaagagattgaaggaggcatcatatcttctgtggttcctccgttaaaccgcacactcatatccgccgtcagaaagattaccggaatctatccgaagctggtcggttccggtatgaagacagggctgaacatcctgatggacaatccaaagtcggtcggcagtgacatgatcgtcaattccatcggcgcccttggcgaacacgaaccgcccatcattatcatcgaaatgggaactgccacgaccatgtcggtcattgacaaaaacagccgttatatcggcggcgccattcttccgggtctgcgcgtatccctagacagcatgagttccaacacggcccagcttccgcggatcagccttgacacgccgaagaaggtaataggaaaaaatacggtggattgcatgagaagcggcgttattttcggaaatgccgcgatgatagacggaatgctgtccagaattgaagaggagcttggcggaccggctaccgtaattgccacaggaggcattgcaaaggcggtgctgccgctctgcagccataacatcatttatgacggcgctctgctgctcaaagggctgctcgctctgtatgagaaaaataaataataaataggggtttgctctgaggctattagcctctgatactgtctgcgtctctaggcacttttaaagttcacataacgtttccggatgttctatgttgaacttgctgccattactttcatgaagggcttcctcgaaaaaacagaaaaaggctaccggatacagtcaccggaagccttatggaaaattgcgcactctgacgaaggcgcataaattaaatttcattcttatcggacttctgcccttcatttttgggaaaagcccctgcatagaccgttatatccggttcaagcccctctatttcgacatgcattttaactgttttatcttctcctgaaacaaacagaacgttcatacccttttttaatgtcaatttttcttctgtccagaaaatattgtaagcctcctccgtagccgctgtcagttcctccgatgtcttgtctttggagccctcatggtagtaaccgagctttacgccatcctgatgggcggtgctgtacgtataccgcatcgttaccgtcgtatcctccgatacctccaggaacataaaagccgcctccgtctccttcaggtaagcatcaaaatcgacggatatcacatcccctatgtcatctttaatcgtgttaaatatactggactgtgcatttattaccggtcggacggcactttcatgttctgtcccgctttcggatgccgcacgcgctttcccgccgcaggcagtcatggctaaaccaaggcagataagcgccagcgatagaactgtcattttcattcctctattcctcctttgattgatattatttataacgaggcatccattaccatctcttcaaatatttaccgtaaaaagaaaactgctataatgaaactgcgataataaaacagggaaattcccctcccggcgtcttcccggaatccatcgggaaaataccggggcagaattcccccttgctgttctcagttataatttacttatcctgttccgggcctctcttctatattaccctattattttactacttttaatgtagagcattctttctcgatattgtcaatcttttctctgtccagcctgagtccgaagccgaagggattgacaacgattccgtccactttgcgcaccagttttttcagatcgcggaacttcacaagttctgtctggtatttctgtttcttatcaaatttaccaaactcaatatgatcggtgaataccggataaaacttcattcccttattatctgtaataattgggtaagctcgctcattccggctttcggacggaagcagaaactttgcatgatatatctcggaacacatcatgtcctgcatcggtttcaccgccctttttctggaaagctcctggtagaactgggccgccgcacgcatcagagatggattcacgataatatcgccgttgtcctccggtttctccacaatgctgaacagcgacatggtaagtgattcctgtcccttatcaaccacaatggcttcaaagccgctgcggtataaatcattaaagaagccgatcctctgagccgctctgatctccagactcttaacctcatatccttcccactttaattccttcacaaattcatcggcaaacgccttgctggaaaaaatataagcggccggcttggcgttctccgctcccataaaaaagttatttgtaactctggctgcaactgcaaacaggctgtcacccgtgcgtatcacatccaggatttccccaaaaaccgctttatcttcattctctaaataggattttattaattcattaatggttttcattctattcctccgtctgtatgtatcatcggttactcgtactgccatcaatttgtaacagttcagacagcatgaactgatacggctattttactattctaacacagacgcagccaacaatcaatcaactctctgaaaaggaaaattttttcattcctccggccgtataaatcggttcaaattcgtacatcattcatttataagaacgcggtgacatgcatgcctcaaattcatttcaccgccaatcaatgaaagatgcggaggtaaagtacatgcctgtttacaaagtagaaatctgcggagtcaacacttccaaactgcctcttctcagcaatgatgagaaggaagagttgtttaaacggattcttgatggcgatatggatgccagggagcaatacattaaaggaaatttgcgtcttgtcttaagcgtcatccagcgtttttcaaacagcagcgaaaatgttgacgatcttttccagattggatgcatcgggctgattaaagcgatagataattttgatataacacagaatgtgcgcttctccacctatgcggttccaatgatccttggtgaagtaaagcgttatctgagagataataattcaatacgtgtcagccgttccctgcgcgatactgcctacaaggccatctacgcccgtgaaggactgatgaagcggaacttaaaggagccgaccatctgcgaaatcgctgatgagatcggagtcagcaaagagagcattacctatgcgcttgatgccatacaaagtccggtaagtctttatgagccggtctatacagacggcggcgatcctctctatgtcatggatcagcttagcgataagaaatgttctgaggagcactggatcgaggatatttcactgaatgaagccatgaagcggctcccggagcgggaacgccatatcatagacatgcgtttttttgaaggcaaaacacagaccgaagtggcggaagaaatccatatcagccaggcccaggtcagccgccttgaaaaaagcgcgctgaaaaatatgcgcaattatctcagttgacatcagagggaacgaggtaaataatagattgagcggaattaaggccggaagaatatcaccggttttaattccgctcaatttggtgtggtatggtgtagttttagtatttaactgaggttgggaggacgcgtccggaacggaccatgtccggtgtggtgggggagtttgtctgagtcttccgtccccggttgaaggttgtcgtgaggggggaatccggccggaatgaattgctgcggggaccgtttgcactctttggagtgcgcatcagtgctaagctcgtgaggaacctcgctaagcaccggcggagtctttcgttccggcgaaaaccttccgggagaaggagatactgccgacatcttccggcggagaaggagagaatgatatccggaaggacgttcgcccgagagatgatagctcttaggcagagggagacaaagcgcgccgggcggattttagccctacaagggcaaaatccgggacaacttgagcttcgaactcattcggagttcggagcgaatttgtccgtaaccccggggggctttgccttcctctgtcttagagctatccctcgaagaagcagtccagccggatatcattctctccggctccgccctgcgaaaacaaaaccacagtatctccttctccatccagcaatgccaaccccccgggacgaaagactcatatacacaccccaccaccccgtccgctggccgttccggcggcgtcctcacctgcttaactaaatccccagataacaacgtatcacaaatctactcgattgacacatttccccgcttattttatactggataatatgatattctttaaggctgtatcacaaatcagccaggaacctgaaccgatacttgagattaaacaactaaaggagtaactattttatgaatccaaccacacaatcacgttccccctactgggatattgtaaaaggaatcggcatcattgcgatcgttctcggacacagctgttattttgccgtaggctttgtctatctcttccatttggcgctgtttttcttcgtctccggctacctgtacagcgaaaagaaatacggggatgctccctttgcctttttcggcaaccgctttgccggaacatggccccgatacgttttttatacctcctgcttcgtgctgctccacaatttctttgtaagccgggggctgtatcagaaccaggagctgtataatcatacaaagatgctggctcagatttgtacaaatatctcctttaccggttcggaaccggcacagggagcgctttggtttgttcccgcctggctggctgcatccggcctgttcggcggtaccgtttggttcggccgtaccgtttcaaaacgaatcggaaggccgggactcaaggtatggctgattggctttgcatgtgccgccgtcggcgccgcaggagtattcctaaacatgagaaaggtgggaattgcctataacctgcatgcttcctttgtcgtcgttcccatctacttttttgcctacctgctgcgctgctgctgttccgactttaagaaatacaccacctggtacggatgtgtcatcagcgccggtatcctgtatttcatcaacgcaaagctgggaatttatattctgcttgacggaatggtgataccgggcttatggttctacgtcatctcgctgatcggaatctatttttgtctctcacttggaacgctgatggaaaaatcaggagcggcatctaaattcctgtcatttctggggcgctactcctttgagattatggcaattcattttgccgtgttcaaatttgtagactatgcctatgccaaattctggctcagatcggttcccgagaatctggccggtttcccgaccggattctcccatgaactctggccgctgtaccttatcgcaggaacactgatacctgcttttatcggatgggtttctactcgtattttacgatttcttttttcaaccgcttcataattttcttttcaagcctggagatgtaggactgggagataccgaggaggtcggctacctccttctgtgtcatctcatcctcattctccgttcccagaccgaagcgcagctccacaattttctgttctctcggattcagcctgcttatagccgtgtttaaaagacttttctctatctcatcttccaaatcccggtatataacatcttcatccgtgcccaggatatcggatagcagcagttcattgccatcccagtccacgttcagcggctcatcgatggatacctccatcttcgtcttattgttccgtctcaaatacatcaggatttcattttcgatgcatcgtgacgcataggtggcaagtttgatgttcttgtcaatattaaaggtattgattgccttgataagtccgatggaaccaatggaaatcagatcctccacgccgacgctggtattgtcaaatttcttggctatgtagactacaagcctgaggttatgttcaatcagctttgattttgcctgggcatccctttccgttcccagttccttcaggacctcggcctcctccttgctgcctaatggagccggaagaatatctgcaccgccgatataatggacttcaccctctttctgaagaaaaacagatttaaatgtcggaaccatcttgagacggaattgattcggtactgctaactttataaccatggtttctttcctccttaataaccatatcttttttattctcatattctcattacatgataccagggtcaaaaggttggaaatctgatgcaagcttgcttgcatgaagatttttaatcttgggacatccggtctttttatacccaaagcttttcattcagcaatatctgataggaatcattctgtgacagtttctcttccgatattgcgatatacggtttttctatgatttttttctgtccttctttttcaatctccatcctgtctgccctgacagccggtaaaatcccgctgtcctttccgaccgaccggaaggggacgaatataaccgcattaacggtcccgaacagctccgtacagctggcagccgatatgacgctgactggattccccgtataaggctctgtcagccggttgcccgtatcgagaaacccagtaaagctggcctctctgccctgatactctatcaggactttgtataaatgaccgttgcccgccgcgctctccgataccatcctccacagatacaatgttaaaatgatactgaatcccactgccgccgcataaagatagatagaggtatagaagccgccggcccggaacagttccatcaaacctgccagtatcactgcggacagatacaggcctgcgacaattctgagaagcgctctcagatccttaaacttaaatgccagagccgtcatcagtgcgctggccgcgcaatatgtaacaattgactggagaaaaaaaacaggaaagggaaaaatggtcacagccagcgcgtaaaaagctcccgccatgctggccagaaatattcctccctttcgtgtctccagcttcatcactttttttacaaccgtgagaagcaaaaaatctattgtaaaattgttggccaacaccacatccgcataaacgttgtatgtcaccgtaaagtatctcacccctctgtctgacggtactgtgatccggtctgcaaatttcccccgaaaccattttcaggagcgcattcaagccggactctgacctgacagtagtcattataaattcccgggcttgtgttttttgtcaaatccggaaagttaattcctgtttttgatcgtcatatttcgaaatgaactgcgtatggaggttcccggcctttccagcaaggaatcgttcctgatttttgccgttctccttttggttacaggctctcttaataaatgacgcagcgccttgcactgctgtaaaacgtaaaaaaagagacagaaacctgctctgcgggtttttgcctctttttttgtcttcagtatattgttggatttcattagaaaatgtcgaataggagagggaaatctgttattgcaccaaaagagccgcagtgctcatgcactgcggccaggatgctctacattctgctgtttattttatacggaccgataattatttcttatttttcaggaaatccggaatgttaatctgggtttctctctgcatcggacggtatggctgtaccggcgtggacgactgagcaggagcctttggctgctgcggtacggctgcggaaggtgccctgtaagtaggcgccttataggttggtgtggatgttgcggccgtttccctgcccgctccctgaggagcaaaggaggctgccggttttgccttgaaaggcgttgtaaactcagtcatggcttttgatacaggcgtgttaaccccatgggcatccagaccggttgcaatgactgtgatggtcgcttcatcctgtgcattctcatcaaacatggcgccaaagataatattggcatcatctcctgccagctcctgcacataagttgcggcgtcgttagcctcgatcaggctgatatcaccggaaatattgataataacgtggcttgcgccttcgatggttgtctctaacagaggacttgccacagcctgtttaacggcttcgatcgctttgtcgtcacccttggcatgtccaataccgatatgtgcgatacccttgtcaatcataacagtctgcacatcggcgaagtccaggttgataaggcccggtacattgatcagatcggttataccctgaacggcctgctgaagcacctcatccgccttcttaagggcgtctggcatcgtggtacggcggtctacaatctcaaggagtttatcgttaggtattacaatcagagtatctacattggcttttaacttttcaattcctgaaagggcattgcccatacgtgtcttggcttcaaagcggaacggcttggtcacaacgcctaccgtcaggattcccatatcctttgcaattctggcaataaccggagccgcacctgttcctgtgccgccgcccataccgcaggttacgaataccatatctgcacctttcagtgcctgtgccagctcttcctggctctcttccgctgctttctcgccaatctccggcttagcgcctgctcccagtcctttggtcagcttttcgccgatctgcatcgctgtagatgccttacaaaactgcagcgcctgcttgtccgtattgattcctataaattcaacacctgcaatattctcttcaatcatgcggtttactgcattatttcccgctccgccaacaccgattactatgattctggcagaattctctgattcatttattttaatctctaacaagatagttcctccttcacttatccatctgatcctgtttatctttataatccgcagccgacggcgcctgtatacattacctttattactgctgccgaacagctacaataatccatctctgttctgggttatcaaaatctagtctatctaatactatatttgattttccgtaaaaaatcaactgtgaatttcataaaatattacttattttgtttttgtcggatccttttaatcgtttatcctgtatgtttttagcggcccgtcttttaatcatcctgttcaaaacggtatgatgggtttgaattggtttcatcatacgtatcgaggtataatgttccgtcaagcgctgaatacgtattgagaatatccctcagttccgatatctttccgttcatctggacattgcttcccagctccacctgcagctctccaacggtaagtgttgcttcccgctggctgttaaaatgaatccgctccgcctttatatcatacatctcaagaacctgggtcagattcagaatctcgtcaaaaattctggcatcctccacaggcagcggtttgtgcagaacaatctggccgaagcgcagcccgctgatcatcggaattcccggcagcttatcattggtactctcaacaatgataccgtccttatcgaaatacatcaggctgttcatataagaaacatatccaaccacacttttttcatatgtgataatctccacattgacaggacttctgaatactattttatagtcttccacaaaaggaatcgtcttatgtggacggaaacgatactgataatagcagtaaacgggatttttgcttaattttgtatcaaaaatcatgctttctatctgctcatccgtatatctctcgttaccgctcaccgtcacgcttttaatcctgacagaaaaaaggacggcaagtaacagcagcacagtcagaaaaattcctgcaattaccagtttttttctgtttttattcactcttctcaactgtgcacctcctgtttacttcccgcccggcggttctgccgctgcaattttatctcactccatatagcggatgcaggcccccatcccggataaatcacggcagatgtcttcatatccccgcataatgtattcacagctttggatgatcgtagttccctcggccatcaggccggccgccaccagcgcggcgcctccgcgcagatcccaggcattcacctcgcaccctttcagcagaggacggccctggatttttgcgatatcttcctcgatgacaatttctgcgcccagcttctgaagctcatttgccgttttgaagcggctttcaaaaatcttttcttcgatagtgctgattccccgcgcacggctcatcacagccatcataaccgactgtaaatccgtagggaatcccggatacggccctgttttgatagacgccgcgctcagccggccggcagctttgagataaataagctcctcttcttcgaagacggcagcccccatctgctttaataccgatgtgaccgtctttaatccctggctgcctgtgcctgtcaggagaatctcccctccggcccctgccgcagccagtagatatgttcctccggctatcctgtcaccgcctacggtaaattcggaatcgtgaaggggaagtccgccttcgatcacaagcacgtcaccgcccactcctctgacggaagcccccatgttattcataaaacggcacaattccactatctccggctcttttgcgcatccgttcagaaccgttttacccgaagcagccactgcggcaaaaatcgcattttcagtcgccccgacgctgggaaacggaaaatccacaaccgttccgcgcagccgcggcacactggctctgagcggctcatctccctgcccttccctgattctggctcccatcttttcgagggccatcagatgaaggtctatgggacgttttcctatcatgcagccgccgggataataaacctcggcttctttgcatctgcctaaaagcgctcccagcagcataatggaggagcgcatcttctccatctccgccttgggaatggaaaaacgggacagccctgccgcgtcaatcgtcaggctgtgcccatccaggacgcagctgcatcccagagaatcaagtatccccatcatacagaacacatcctgtattctggggacattattaatgaccgttatgccattgttcagaaccgctcccgccatcatcggaagaaccgcattttttgaaccctgcactgtaatttcaccttttatcgggcacagcccccggacctctatcgcagacaagaaaaacccctcccatttgtcttctatatactatcctatgtgaaatatgaacttttgtgcagctttttatctgattccgtgtacggttcggtgcgaaacggcggttttaccgccgtcccctactgctccagcttaatctggttcgatacactaagcaccagccccatctccagcatcagaaacagtaccgatgtgcctccataactgataaacggcagtgtaacgcccgtgttggggatcgagttggtaactacggcaatattcaaaataacctgaatggcgatatgcgccattactcccgttacaatcatggcgccgagaagatcgggggcattgcccgcaatcaccatgaaccggtaaatcataaacataaagatcaggatcagggagattgccccgaataaaccaagttcctcacagataatagaaaaaatcatatcattctgcgcctcgggtacaaatcccagcttctggaggctctcgcccagccctttgccgaataatccgccggaaccgatggcatacagcccctgaagcacctggtagccgccggaacgtgaatacataattggattcttccacacattgatacgtcccagctggtaatccttcaatatatgcatatttaccagtatatggccgatataaggagctgcggccagcagccccactccggctccggcacaggcgaaaaagggccacttgattttacatgccacaaaaagcatgacaaacacgataccgcagataataatacccgagcttaagttattcgccgtaaccaggagagccagaggaagagaaaatccaatgataacaagtgtcggcctgagtttgttgattctcgttcccagctcggctatgaaaaccgccacaaagagaatcagagatatctttacaagctccgtgggctggaactgaagcatgcccggcccgaccttcagccatctctttttaccgtgggacgctacgcccagagggctgaacatggtgagcagcatggtaatccaggaaagagcataacccagcacggcaaacctggcaaaccagtgataatcaatctttgagactatgtacatgacaacaaaactgccgcccgcaatcgccgcctgcctgattgcaaaatacgcaggattatcataatcgagctgcgccttataggagctggcactgtagatcattacaagtccgaacacagtcaggaaaatgattgtgaacaacaggctgtaatcataaaatcgatgcggtttctttttcttctttttccccgtatcaggcattaattcctactcctcatccctaaggtaagcccaaacggtgaaaagtcgtataaacgtccttttcaccgcccacaaagcaactataaaataagagataaatggttacaggccccttacatattctttaaatttcgttccccgctcctcaaagtttttaaactgtccccagcttgcgcaggcaggagaaaggagtacattatcgcccggatttgcataggatgcacatacctggactgcttccagcagatcttccgcatacatgatatccgtaaatccatggcgtttggcacattctgcaattttatctctggtctgtccgatcagtacgaggtaccgtacctttccatcaaaactttcaatccactcatcaaattcggaatgcttgtcatagccccctgcgatcaaaatcgtcggcccgggcattgccttaattgcctgcattgccgcatccggatttgtacccttggaatcattatagtattttacgccaaagcgctcggtaacaaattcaattctgtgctccaccgcctcaaacttccggatcacttcctgaattttttcaagcggaacatccatattcatgctgatggcgactgccgccattacgttctcatggttatggcgccccagcagcttcagctcacttatatccacaatctccgtcaccttgctgccgtcattgtaaacaatctttccgtcttccagatagtagccctttttcagtttctcgcggctggagaaatagaccacattaatcttgagcgtttcaccgaattcccggagtacggtatcgtcataattgaggacacaggtatcgccgtccttctggttctttgtaatgctctcttttacctgcgtatagcattccattgtcttgtggcggtccaggtgatccggcgtgatatttaatatcgcgctgacattgggacggaaatccataatcgtctcaagctggaaactggaaacctcggccacggtaacggaagactcctccgtctccagagcatgcgccgtatatggctccccgatatttcccactacgaaaacactgtcataaaacgatctcataatctcgccggtcagcgccgttgtcgtcgtctttccgttagttcccgtaattgctgccagctttcctttggcacagtggtatgcaagctgaatctcgctccagataggtactcccgcctcgtccaaaacggttacaaaaggagcgtccagaggaataccgggacttatcactgaaagctcaacacctaacagatccgtcctcttaagttcccccagaacgaccgatacctttgcatcttcatcaaagttcttcttgatcttctctgcatccagcttatcatttccgtcataaagcaccacttccccgcccttggcaagaagaagttttgcggctgcaataccgctgattccggaacctgctactaatactttttgactcatcgtccattcctcctataatcctaagtaagctacaaggcaaaggattgccgttataatcgaaaatacggccacgactcttgtctcagaccatccgcaaagctcaaaatgatggtgaatcggagccattttgaaaatacgcttgccgcccgttttcttaaaatatgtcacctgtatgatgaccgacagaacttccaccagatagatcagtcccactacggctatgaaaaggggcatctgcatcataaacgcgctggatgccacaaagcctcccagagccagtgaacccgtgtctcccataaacaccctggcaggatatacgttaaacagcagaaagcccaggagactgcccacaacggctcctgtaatcgggctgatgccgctgttctcaccgatagccacaattgtaaagaaggtagctaccaaaatggtgacactggtacaaaggccgtcaaggccgtcggtaaaattcacaccgttgtctgttcccagaacgataaagaaaagtgccggaacaaaaagccagaccggcataaccaggtattgccccgtgaacggaataagcatctgcgttccgatctcatcagacgtaataatataatacgcaaagattcccgtaataatgatttgcccggcgagtttctgtccgggattaagtccctccgaacgcttcatgacaatctttatatagtcgtccaggaaaccgatgacgccgaatcctgcggtaacgaacaggacggggataatcttcggataatctttcaggtataagagcgatgtaataataatgcttgaaagaattaccagtcctcccatcgtaggagttccctgctttttcagatgggcctgggggccgtcgtccctgacctgctgtccaaatttcagtttgtgaagaaacggtatcactatcggacacagaatcgcgctgattacaaatgcgataattaccgccagtattgtctcatttaccatgtcacacctctaattcttatgtagtctctgccttattattttctatcattctaattttactacatacgaagatagtatacgtctttttagtagaataatcaaccttttttgttctgccgtgaagtctggcgtaacagttcggacaggcagctgctaaggcataatggagatttagccaaggcccggaggacgcgtccggaacgaaccacgtccggtatggtgagggggctggctgagtcttccgtcccctcgggaggttggtcgtggagggggaatccggccggaatgaattgctgcggggaccgtttgcactcttcggagtgcgcatcagtgctaagctcgtaaggaacctcgctaagcaccggcgtcctcacctgcctaattatcctccgcctctgttttaggtatcccaagataaggcaatatattttcaaatatgctccccacgacaggagccgctatcgtgccgccgtagtaaattccttccggttcgtcgatcgtgatgagcgctattacctggggatcgtcggccggggcaaagcccacaaatgatgaaatgtatttcttcaggcttctgggaagcttttccgatgtagccgtttttccgccgattctgtacccctctattttcgcattctttccgcttccctcggaaactacctgctccagtatataacgcatcgtgctgctggtctcctccgacaggattctgtctcctaaaggaaattcaaacttgtggacagaacctgtctgcggactcaccgacttcacagccaggtgcggagtcaccctgtttcccccattgataacggaggatgccgtggtaatgagctgcagcggtgtaatctggaaagactggccgaatgatacggttgccagctccaccagccccatattttcctttttatgcataatggtggctgcctcgcccggcagatcgattcccgtctttccgagcaggccgaactgggcaaagtatttatagtaattatcgactcccagcctctgccctacatcgatcagcaccggattgcaggaattcatcattccctgaaggaatgtttcacctccgtgccctcccactttatggcaacgtatttttctgtcttccacaacccggaagccgggacaggaaaaattatcggtcagctttactaccccggcctccagaccggccgcagccgtcacgattttaaacgtggagcccggctcatacgtgtcattaatgcatttatttctccacatctggtttaaaagatcctgggaagtcttgccgtctccgtccgccgcaatgccgggtatcagtgtaaacggttcatttaaattgaattccggcacatttaccatcgcgagtatttcgccgtttttcggattcatgacaacgaccgatacgctgttggcctgttttttctccattacctggtaagcggcctgctccgcatatttctggatattgacgtccagggtgacgaccaggtcattgcccgccaccggctcaatccggtcctcggccgcattctctatctctaccccggccgcattcgaaagcgtcagtatttttccgtcctggcctttcagatatttctcatactgaacctccagcccgatgataccctggttgtctcctccggtgaaaccaagcactctggacgcaagactgtcataaggatagtaccgcttatagtcctcatcgaccttaacgccggcaagtccctgtgcacgaatcttgtctccttctttcttgtccacatttgtctttataatctcacgcgcagaatatttttccaccttttttctgaccgtatcctccggcactcccagttccccggaaagtatccggatgacgctttccggatcctcaatctggttatggaccaccgatatggtacagactgtccggttgtcggcaatcaccacaccgttccgatccagaatccgtcctctggccgctttaatcgtcctctccctctgatgcagatcctcagccatctcactgtaatagtccgctttataaatcataaggaagaacagccttcctgtcagcccggccatgcacaggcataacatgatacatacgaacgctattcttcctctgtgatgtgtctgatttctgttcatgcggtacctttatgctttcgttggtacagtatattaaaaaatcagaattttattcttgttacaacccacgctcggtttattatcgaagtgcggctgcatcctatgcggacacgtggttgacctcatggcagtgggggataccgccttctctccgcccaccgctgccgttaaatttgtttgggcaattcatctcaccaccttagaggatgggaaaatccttgctaatatttgttgaacattattcccggctgccttctgaagactcggtcatacctcccccggtgctttcagccgcattggtgctttcaggcattcccgggctctcctgcggtgcggttaaacctcccggcatgctgtcgggataattgtaatcttcttcccccgaatcaataaactcatcatcaaatgacgcccaagtctccgtcggggcctctgattctccgccttctcccgcgccctcctgtccttcctggctctctgaagggtcgccggatgtgatgccctcttctcttcccgccagatcttcgtcttcctgcagacctgtttccgtatccgggaatacattcatatacggaaggatttccgccatgattttagccgaaatctcactggcaaatctggaatgggcctgttcctcacccggaaggttcggtgtgtccaaaaccacgtaaacgagaacctgcggatcgtaagccggcgcatagccgataaacgataccagataatttttggcttctctcggctgcttctgagccgttcccgtctttcctgccacctgatatcctgccacggccgcggcccctgccgtacctccgtcgccggaaacagtctgatagagcgcattgttaatatagttcgatgtattttccgaaaccgtctctcttaccagtttcggctcattcttcttgacgacggcgccctggtcatttaagattcttctcacaacatgcggctcatagtaagagcctccgttgatcagggaacaatagccggccgccatctgtatcattgtacagttgtaattctgtccgaaggcattcgttgccaaatcgaccggtcccatattatccgccctgtatacgaggccggatgtatcagcttcacccggaaggtcaatgcctgtcttggaaccgaagccaaaaatgctctggtattttgtaaacttctcttttccttccagacgcacaatattcatcataacgatattgcatgatttcataagcccctgcgtgacggtaagaggcccgtgaccgcttctggccacacagcggatcgtccatctgtcgtccattttctgcctgccgccgcattcaaaggtctcatatcccgtgatggctccttcttctatcgcaccggccacggtaaatgccttctgcggggatcccggctcaaaggtatcactgacgcagaaattacgccacattttataccaggcgtcggcctttgtcttttcatccatggcagcctgttcttcctgggtataatatcggtccatattataaggatcatttaaatcatagcggatgttcgtatccatcgcaagaatctccgccgtattgggatccataacgataacggctgccactttacttccaatgcccgcctgccattcgtcaatatatttctgacagattttctggatattcgcatcaattgtcagttccagcgtttctccgttcttagccggcttcaccactctctccagattggaatcgtcattgagatatccgtactctctgccgttcacgccgttcaggacgctgttgtaatactgctcaactccgccggaggcattgccgtccttcattgcaaagccgatcacgttgcaggccagctccttatatgggtataccctcttgtactcatcttcaaaccatacgccggtgattcgtctcttgccgccctcatcgaccggcagtttcttatactcggcattcttctcctgcttgtaattttcaaacagctccttctgctccgccgtcatctgtttttcataaacgacataatagctgtctttcctgtcattgatcagcttgcgcagctcttcacggtcatagccgaagcactcgttaagcgcatccagcgtcgcttccagatattcgtagttttcatcattttccaatatctgtttcggatcgataatcaggttatacactttctcactgatagccagatacgttccgtttctgtctacaatgttcccccgcttaaaggggatcgttctgctctcataatcctgatggcttaaaacgatctgattatagtcttcccctttgttttttacaatattataaagcaccaataccaatgcaaacaaagccagcgtaattaccaaaacggtaatcgccagcttttcctgcatgtactttcgaaagggctgtttgttattagtgttttgggatgtcctcatactgccttacatactcactttccgttttattatacaaaagaatctgattcttgttggcatataccatgccaagttcttctgtagcgaccttaaatacatggtctaaatcaacgtaagtgtcaattcttgtctgaagggcatcattttcagattttaaatgttccagtttcagttccagcgtttctatattattgattcttgatgtaatcgaagcttgtatatgcaggtaattcatacataaaaacagcgtaatgactgctgctatggtcagagcaaacacatacggaccgtccatatagagagctttgtccctgttcctccgtacaacatggctgcgtttatagtcgtcctgtaccctgcgctccggctttgtctgtggtgtggttctatttacttttctcacggtattgccgtctacatacgttccggcatattcaggatgtcttcttctggcagccataggtctttacctcctactcttttcaaacactctcagctttgcgcttttggaacgcttattttctgaaagttcttcctctgacggtaaaatcggcttgcgtgtcaccacacggcctttactcttttttccgcacatgcacacggggaagtcgggcgggcaggtacatggattttcattgattctgaagcggttcttgacaatccggtcttccagcgaatggaaggtgataatggaaagtctgcccccgggagccagaagatccgtcatcttgtcgatggaattttccagaacctccagttccttgttcagttcgatccgaatcgcctgaaatgtccgcttggccgggtggcctcccgtggctctcaccttggcgggaatcgcggcttttataatttcaatcaattctcctgttgtctcaatctctttttcctgacgtgccctgacaatgtgcttggcaatattcttagcgaaccggtcttccccataatttttgataatatggaacagctctgattcactgtaggtatttacaatatcttttgcggtcatttcatttctctgatccatcctcatatcgagcggggcgtcatcctctctgtaggtgaatccccgttcagccgtatcaagctgataggaggaaactcccaaatccagataaatcccgtcgacttgactgattcccagctctttcaagacctcatcgatattctcatagttgcttcttacaatcgttactttatctccaaattctttcagacgttccgatgcggccgctatggcgtcggcatcctgatcgattccgataaaccttcccttatctcccagtctccggcatacctcgctggcatgtccgcctccacccagggttccgtccacataaatcccgtccggctttatgtcaaggctttcgattgtctcatctaaaagtactgatttgtgtccaaatatcatattccaaggccttccatgttctctgctatttcgtccatgtcgtcatagacattcttctcggtccaggttgctttattccaaatctcaatccggcttcccacaccaaccagaaccacttccttctccaggcacgcaaactccctgagtacggccggaaggagtatccttccctgcttgtccacctcacaggcagaagctccggccagaaaaaaacgtgagaactttctggcattcgtattggtaagcggcagtgactggagcttttcttcaaagtttttccactcagaattatcatacacaaagagacagccatccaacccctttgtcacgacaaattcgtctccaagctgttccctgaatttggaggggacaatcagcctccccttcgcatcgattgtatgattgtattcacccatgaacatagcaatcacctgtcatccaatttgctccactaagcttccacgcagaaccatttagtaccactttctaccactttccaccactttgtattctaattctagtacatctgtaaggaaatagcaagaaatatttattaaaatgtacagaaaaaaagatggtaagatctggaaatcttaccaccttttttaacgactctacatatgtaattttcttagcaatcagctacaacatattgattcagcagctgatcaagctccacactgcattgataaatgataccatactcctcctttttatcaatgcttctattcaaccgttctcttgcatgttcaattttactgatcaattcttctctcgcgtttgccatatcctactctccttttgttgttgctgtcttcagttgtggcgctgtcagaggatatattgtattgtaaaacgtttgcacaaaccggtattccagaccctcaatccaggaatacagtcttaaaataagatatccgatgtcagcaaccgaagcaacatttacaaacaataatgtttgtaaatgcctccccggtgtatcttcattttaagtccttattccctaaaaatcaaacaaattcggccgataatattcgacaaaaagtgacgcatctcccttatttattatccgatccccttataaataatacccagaacaaacacgataattgtaagcggtacgtagattccgcaggcaattttcccaaacagggaaggcattgatttcgttctgccctgctccagttcttttcgtatttctttgtaaccaagcacataataaacggaaaccgctcccaataccgctccaaaaggaaccacgaggattgtgataaaatccatccattttcccacggagggttccgcttccaggaagactccgaccacaaagcagataattccgcaaagcagaacggccagctttcgcggaacttcaaaccggtgctggatactttcaattaccgcttcaaacatattaattaaagaagtaatccctgcaaaaaccacggacaggaagaatatgacggcaaatatctggcccatcggcatctggccgaaaatcttcggaatcgtgataaacattaaggaaggaccggctgccggctcaattccaaaagcaaataccgcaggcataatggcaagggcggaaaggagagccgccaccgtgtcaaataacgccgtacgcatcgacgaacctacaatatctgccttcttattcagataagaaccatagacaatcattcctgaaccggtgatggacagggagaagaatgcctgtcccatggccataacccaggtatttacgtccaacagcctttcccactttggcacaaaaagaaaattgtacccggctgaagctcccggcaggaagaatacgcggaccgccaggacggtaaacaaaacaaagaaaacaggcatcatcacacggttagcccgctcaatctgggtaacggaacctgtaaccaggataatcacggtgattagaaccaccgccaggtgccagggcaggctgccgaagcttcctgtggcctgtgcgaaataagcggccgaatcctctgtaagaatagcacccgtcagggaacctcccagggagcggagcacccagccgattataatcgaataaccgatcgcaatacccagggaacccataaggggaatccatccaagaaaacgtccgacggcgcctttgcctctgtgggcccagcaaagctcataagacccaagggttcctgtctttgcctttcttccgatggcaaactccgccgacaggccggtcaggccgaacaggcagataaaaaagagataagggaccaggaatgccgcccctccgaactggcccagacgatatgggaacatccatatgttgccaaggcccaccgcagaacccacacaggccagaataaagccgagtgaactgctgaaatttccatttttgtgactcatgtaataaccctcctcatagatagtggtgaaaagtccctgaagccaaaaccacgaaggaaccttttcatcgcccgcatacatgcgtctttagccctcccgcctggattcacatgcatgctatgccgctttaaacggcaaaatcagttctatcataatatatactgcggataaaagcaacccgggatggagatttaattgagaatagaggacgcatccggaacggatcggggccggtgcggtgaggttggtttttctgagtcttcacggtgtgggtgtgtcgtgagggggaatccggccggaatgaattcctccggggaccgtttgcactctttggaatgcgtaacggcgctaagctcgtgaggaacctcggtaagccggtgctattcctccggcattcattccttcaatctatcgtaaactatttacttacataaataaaatgcaacggatacccaaaatatatacagtatactcagcaactccataagtctctatttctcccgcctttggaagcactgagcggccgcgacaatactctcctccgcacttaacgcgtgagacaatcagcggccgcaggccagcggacggggggcgatacacttagcttgagtctttcgtcccggcgacaaccttccgggagaaggagatactgccgatatcttcctgcggaggcggagagaatgaaatccggaaggacgttcgcccgagaggtgatggctcttaggcagagaaaggcaaagcgtgccgggcggattttggcccttcaagggcaaaatccgggacaactgagcttcgaactcatccggagttcggagtgaatttgtccgaaaccccggtgcgttttgcctttctctgtcttagagctatccctcaaaagggcagtccggccggatttcattctctccgcctctgccctgcgataaaaaaagatgcagtatctccttctccaacccacgacaaaccttccccgggacgaaagactcatataccccacctcaccaccccgtccgctggccgtcccggctgcgtcctcacctgcttaactaaattcctcttccttttccgccgattctatggtattctattcaagtacgtccaaatgtaaaagctctaatgaacttaataagcagtattatgcttatcaataatagaaaggaagtttttattatgaaattaggtattgtaggcctgcccaacgtgggtaaaagtactctcttcaattccctgacaaaagccggtgcggaatctgccaattacccgttctgtactatcgatcccaatgtaggtgttgttccggtacccgattaccgtctcggaaagctctccgctctctataattccgaaaagattaccccggccgtaattgaatttgttgatattgccggactcgtgaagggagcttccaaaggcgagggcctcggcaatcagttcctctccaatatccgtgaggtggatgccattgtccatgttgtccgctgttttgaagatcccaatgtaattcatgtggacggcagcgtggatccgctccgtgatatcgaaacaatcaatctcgagctgattttctccgatatggagattctggaaagacggattgctaagacaaacaaaagcctgatgggcaataaagctcttgcaaaggagcttgatatcttaaaggcgctttacgctcatctggaggacggcaaactggcaaagagctttgagacggaggatgaggacgagcttgctttcatcaattccctgaatctgctcacatggaaaccagtaatctttgccgccaatgtatgcgaagaggatctctccgatgacggcgcaagtaatgaatatgttgcccgggtacgtaactttgcatctgagacaggcagcgaggtatttgttatctgcgcccagattgagcaggaaattgccgaactcgatgaagaagagaaaaagatgtttttagaggatctcggtcttaccgagtcaggcctcgaaaaactgattgcggccagctaccgtcttttaggccttatcagctatctgacggccgggcctcaggagacacgggcctggacaattaaagtggggacaaaagctccgcaggccgccggaaaaatccattccgactttgagaggggatttattaaggcagaggttgtcaactaccaggatcttctggattgcgggacctacccggccgccaaggaaaagggcctggtgcgtatggaaggaaaagaatacattgtcaaggacggcgatgtaatcctgttccggtttaatgtataagcgataacctgcacgctcctcgcacaggtcgccgccatcaattataaaatggtgccggattcatgttaaagctgacatgaatccggcaccattttcagctactgtgtcaaacgcccccttaatctgcaattaacaggacaacttaaccgacctttcccattcttgcataaaaagccggattccgtaatagattgtaataaacaaatccggagggcttttttatgagctctaaaacaaaaatagtagtgctgcgcatgaaggaaatcatttacaccgccatctttatcggtttggggatccttctgataacgctattccttatcatgttccatccgaaaaaggacgccgcccagaccgcttccgacagcgtacagtacataccgggagtatacacagcctccctcgttcttggcagccagaatgtcaatgtggaagtagccgtagatgccgatcacatcaattctatcagcttctcccctctcagtgattcagtcgccaccatgtatcctctgatggccccctctatcacccagctttccgaccagatctgtcagacgcagtcactggaaaacctctcctatcccgagggcagccagtacacttctcgggctctggtaggcgcgattcgtacggcactgggcaaagccacggcaaactgatgcgtaaaatccgtaccataatatacgggcgggaacagggacagaaaattccatctatcggcggaattttctgtccctgttttatctgtccgatttttaacacagtcttacggttctgccgattttcattgtatttctatcaatacaatgagataatgatcaatattccggataatcgggaagcggctgcagatacatatcatggattcagccgcatattgtccgggataattgaatcattttattaactgcgaaatacaaacgggggaattattatgaacgaaacggggaattcattcattacaatcgatttggcaaagattaaatcgaacatggaaaaaatcagaaatcacgtgggaccggatgtggagattatgcccgtcctgaaagcaaacgcctgcggccacggcctgatccgtaccagtgactggctggttaaggaatgcgggattaaaagactggctatcgcccaggtacgcgaagccgaacaactgcgcagggccggcagtcaggcggaaatcatggtactcgggggcgtaccggtaaacaacctgccttatgcggttcaggagaatctcattctgcccgtcttccgcacccaggatgccgctttgctgtccgctctcgctcaggaaaacggaaggactgcccgtgtccatataaaaattgataccgggcttggccggatcggtgtggaaaagggcgagcagctcgaagagcttctggatggtatcttacctctgaaaggcctggaaatagagggagtgtttacccactttggggaagccgaggtcacagacccggagttcaccgagattcagatcagccgttttgaggaagcccttggacaaatccgggcgcgggggattcagccgcgttatatccatgccaccaacactccctctaccgtacggtttaaaaaagcccattacaatatgatacgtacaggccttttgtggctgggatacgatccctgcctcgatgaagataacaggctgggtctcgaaaccgttctggaatggaaaacctttctgacaaataaaaaatacgttttgtcaggcagaagcatggggtattggagaagcttcactgccaagcgtgatacggttgtcggtatcgcctgttttggatacggggacggctatctggaagatttgggcaaaaaaggcggatacgttttaatacatggaaagcgggctcctattatctccgtctgcatggatcagacatttctcgatatcaccgacatacccgaggccgaaatcggcgatacggtaactctgataggtcatgacggcggtgagaagattgatgcctttgatatggaaaagcttacggaaaactcctatgttgtctacctctgcaatatcagcgaacgcccggtgagaatatacagagactgacaatgataaccgtatgacctggcacataatatagaacaccgccttcgacgcttgcctgcacgctccgcgcacaggtcaccgtcatcaattaaagagagtccggtaatccggactctcaaaccaggtatctccctatttatagaatgagctgctgttgcttctatttgtctctttactcaggattcgactacccgctcagttccggcttattcaggcccgttcagaaggcactgtttaaccgcactcagaaatcctcctgcataaatgctgacggaggccactgcatccgatgcataacctgtctcctgcaaaagaccttcttccgactggttttctatcagatattcggccagcatgtcggcctgctcaaaccacagcggcccattttcggtcatcacgtattggccgtcctccgaaagttttctctttcccgtcccctccttatctactgcgtcccattgaagggctgttatcttatgatccttaacgctcatcgtaatctgatcacagaaaccattttcgtccgcctgaccgctcttccagttgtatgagccgtcggccgcccctgccagaagctcatccaggcttgtatgggaagtatcaccgccggcaataagaagacactttttcaggcagtcgataaaaccgccgatatggatgctgacagtagaaaccgcatccgatgttccgctgtcattcatcagccctttcgtcgtctggttctccgtcacataccgggcgagctgatcagcctgttcataccacagcggcccgctttccgtcatagtatactggccgccagcagacatttctcttttaccggttccgtcttcctgcaccgcatcccacgtaagagccgtgatcttattatccttcacttcgatgtcaatccggttataaaatccattctcgtccggctccggttcccggtaagtataagagccgtcggcaattgtctttaaaagctcgtccacttcaggaagcgctttctgggcgttttcctgtgcaatttcctgttcaataatcgccgccagctccgtcccctctttcacggcttcccgcacgcatgcacccatggccgtctttaccgcattgctggtcatcgtggcgcccgatatgctgtccacactgtgagactggtttgcccagatatctttcgagagccgtactgcagccgacttgccaatctccggcgtttcatccggcgcctctactttcacatcttctattccatactccgagaattttgccttcactgtgatcggtccgccgtatcctctggcgcttccttcatatgttcccgcattataaataggaacatccgacacagggaggttctgccctgctatggatttataaagaggacctgagaatgcaatcagccctcctgccaatataatcataattcctgacccggccagtattcccgccaggttacctgtttctctcttcttcatgcgtccttgaatcctttcctttttcatcggctggtgtttctgatacataatagtgccagacctcaaacattttgcttttagtctggcactgtgttactctttttatacttctctcatcctatatctcatcctgataaatatcggatgacagcggatgatactgctccatggaaattttaaatgacggcgaattctccactgcgttcaggaacccaggaacatcatcgtcaaaatcatacgtccacaatgtctcttccagactgttcaaagtctcatccggcatgtaaagcaggtccagatgtatttgttcaatataatcatattctccatccacctcaatggtaaactgcctgaccattgaaaggaaaaatctgtcaccgtccggtaaatcataaattcctgcttcaaaaagcagactgtcatccgcacattcaaaggagagcccggcaaaccttctgaatgcctcccatcccgtctttaaatccggttcttttgggttaaaaccgctctctttcagaacagccctgaacattccaagagcgtctgaggttttcaattgtttcggtgtcttcgtcatgtttcattctccttttccctctcccattgcaccatgtcggcaagtgttaccttgtctatgacaccgttaacagcatcatccaccatggtccacagcttaagcgccgtgcatcccggcgcccggctgcatgtattgcctctgccatccatccgggtatccacacacgctaccggcgccatgcttccttcggtcagtctcagaatcattccgaccgtatattcctgcggttttccggccaggcagtatcccccctgggctcctctgacactattgacatatccggctttctttaaaaccgatactatctgctcaagatacttttccgatatctcctgtctgagcgaaatatctttaatcctgaccacctcatccccctgcaatgccaaatccagcatcattcgaagcgcatacctgccttttgtcgatactttcatttccagctacacccctttatatttattcttcaaacagcggagtggagaaataccggtcacccgaatcaggcagcaggacgacgatccgctttcccctgttctccgctctggccgccagctccactgccgctgtcagagccgcgccggatgaaataccggtaaggattccttctgtcacggcaaactttctcgaagccgcaaaagcgtcctcatcctttacctgaatcacttcgtcataaatatcctgcgccaggatttccgggataaatccggctcctatcccctgaatcttatgggctccggctctgccctccgacagaatcggactcccggccggctccaccgctaccactttaatccgggggtttcgctccctgaggtattggcccacaccggtgattgtaccgcctgtaccgatacctgccacaaagatatcgaccgctccgtccgtatcttcccaaatctccggtccggtcgtcttcctgtggacagcaggattggctgcattggtgaactgccccagaatgacggaaccttcgatattttgttttaattcctccgccttctctatagctcctttcatacctttagagccatcggtcaagaccagttttgctccatatgccttcagaagctttcttctctctatactcatagtctcagggagagtaaataccgccttgtatcccttggccgcagccactgaggccagaccgatacccgtattgccggaagtcggttcgataatggtcgctccctttttcagaattccgctcttctcggcgtcctcaatcatggacagcgccacccgatcctttaccgaccccgccgggttcaggtattccagcttagccagaagaaccacatccgctatcccttggctctccgcataattagacgcctccagaagaggtgtccttccaatcagctgtgctgcgcttttcttaatatccgccatatttttcctccttttgattctgcaatttatatcatagtaaatctataggttttatatgattttatcatatcggaaaaatttgtcaagatttatctgctgcatttagcgcagccatgataaaacgatactctgcacgttccgaacacgggccgccaccttcaacgcaaaagccagggcagcatgccctggcttttaagctcttctcccgttaccgaaacgataacctgcatgctccgcgcacaggtcaccgccatcaataaaaggaaagaaataatattcatccgtgtaatccggtgtttaaacgataactttgactgggcacttcgccgcgcatttaccgcagttcgtacacttctcataatcaattaccgccaggttgttatccatatggatggcatcatcctcacactgcttgatgcagagtgtacagccgatacatccgttatcgcatttagccttgacagccggtcccttttcatgggaattacactgtacaaggtgttccgccttgtatggcaccaattcaacaaggtgctgcgggcaggcgtccacacatttgccgcaggcaacgcatttctctttatctaccaccgcaatgccgtccaccacatgaatggcgtcaaactgacaggcagttacacaagaaccaaatcccatacatccgaaggagcaggctttatcgccggaacccggaacaacggctgccatcttgcagtctttgataccaaaataattatactgtgattttgccttgtcgcaggtgcccttacattttacgaaagccaccatcttctcactgctgccggcttccacgcccataatggctgcaattttctcagcacagggagcgcctccgaccgggcaggcgtcaacaggagcagtaccctcggcaatggcctttgcaaggccgtcgcaacccgggaagccgcagccgccgcagttgttgcccgggagttcttctctgacaaggatttctttctcatctacttctactttaaatttctcgctggcaacgccaagcagcacaccgatgataataccggtagcgccgacgataattgccgcaataataattccagttatattcatccttcgtctcctcctttaaattaatccggaaaatccgaaaaatgcaattgacatgagacctgcggtaattaacgtaatcggggatccctggaagttatatggcacgtcattgtattcaatgcgctcgcgcacgcctgccagaagtacgatagcgatcgtaaatccgaccgcgataccaacaccgttgacaacgctctctacaaagttgtatgtcttctgtacgtttgttaatgcaacaccgagaacagcacagtttgtcgtgatcagcggaaggtatacgcccagagactgatacagggaaaccatgtttttcttcaggaacatttctacaaactgtactaaagccgcaataaccagaatgaacacgattgtctgaagatactccataccgaagcgcaccagaatgtgatcatagattaagcttgccactgcagatgcaatcgtaattacgaagattacggccgcacccatgcctgctgatgtctctaccctcttggatacgccaaggaaggggcagataccgaggaactggcttaatacaacgttatttaccagggctgaaccgatggcaattaatagtaattctttcatctatccattcctcctattctgttttctcgggttctttcgccgcttcagcttctgcctttgctttcgcttcctcggccgccttctttgctgcaagtgctttttcagccgccgctttcttggctgccgccgctctggccgcttcctcggccgctttctcagccagcttcagatggttgtcggcacatgcggaacctgcacagcttgcgcagttgccgccgcatgccaggttggactgcggtacggaaccatttgttgcggaaggagctttaaacttattctggagtgcagtcagaatcgcaagcacgaagaatgcacccggagcaaggataaagattgagatatggaaatcctccggaataatctgttttccgaagaatgctccgccacccaggaactcacggaaaataccgatgagcgtcagggcgatggaaaatccaagtcccatgccgattccgtcgaaaagcgaggaaacagcgtcattcttggaagcataagactcggcgcggccaagtatgatacagtttactacgatcagcggaatgtagatacccagtgatgaatagagggaaggcacatacccctgcatcagcagctggacaatggttacaaggctggctacgataacgataaaagccggaatcctgacacgatccgggataatcttacgcagcgccgaaataattaagtttgaaaagacaagaacggctgttgtggaaagccccatgcccagaccgttgacagcagaagtcgtaactgccagtgtcggacacatacctaacattaacacgaaggtagggttttctttgaaaatgccgtttgatatacgttctacatatttgttcatatttcccacctcctgttagtttatgaaattctgtttgcagtacaaagcggcattaaccgcattcgtcactgcgttggatgtaatcgttgcaccgctgatcgcattgatctcggcgtcgcccgcattgccacccttgacaacagtaagctcggaagccgatttgccgtcatactgggtcctgaacgggtcctctttcgccttaagaccgagaccgggcgtatcgctgatctcgcggaagccgatggaagtaatgcttccgtcgtccttgattccgacggagatagatactttaccgccgtagctgtcattcgaataggagttgattacatagcccaaatcgctgccagcatcatcctttgcaaccattaccgtctcaacgcccacaccgccgaaatccgatgcggcaagctccgtgttgcatgcctccaggtcaatgtctgaagtctcttcaaaagatgacgcctccgggaatactcccctgtatgtcttgttgtttgcttcaattgtggcctgttcaatcgggccttttgtcacttcatatacgccgcccagtgcaataccggaaatcagggtgattgcaaaaaggataaaggcgtctttcataaatccggatttacctgccattatttcttacctcccttttttccaaatgcggtcggaagggtgaacttctcgattaacggaaccaggatgttacagaagataatcgcgtaggatactccctctgcagaacctccgaagatacggaagagacctgtcagaagtcccagtgcgataccgaatacaatctgtccctttggtgtaatcgggctcgtaacataatctgtcgccataaagaaagcgccgaagattaagccgccgccgcaaagatgggccaggatgtagcttacgtcaaatccgctgtaaatagccgcaaaaatagcaaccgtagcaatatatgtaagcgggatgcgcagtgtgattacttttctgaataccagataagccgcaccgattaacagtgcaatcacggaaacctcaccgatggttccgggaatccgtccgataaacatagcggtcacatccacctgctctcctgcctttaacatggccatcggtgttgcgctggctactgcgtcggagaaaggctctgtaaatgtggtcatctttcctgcaaaggaaataagcaggaagcatcttgctgccagagccgggttcatccagttctgtccaaggccgccgtacatctgttttacaatgatgatggcgaatacgccgcccaggcacggcatccagacaggaatctggggcggcatgttgagcgcgagaatcataccggttacaacggcgctgccgtcataaacagtgattggttttttcatcagtttttcaaaaatatactcggaaagcacgcatgataccactgttgcaatcagaacaagaagtgcgtgcataccgaactgccatacaccgtaaattgacgcagggagcattgcgattgccacgtcaaacatgattgcctgggtggtgtggctgctccttacgtgaggtgatgacgatacgttaaataattttcccatttcttcacacctcctactttctgcggctggccgccactgctttgcgcagctctttgaatgcctgtgtcagcggtctcttggccgggcaggtatatgcacagcagccgcattccacgcactccatcccgtccagcttctggaatttctccatatcatggcgctctgcggcgtccatcatcatctgcggcacaaggtgctccggacatacgtccacgcacttgccgcagcggatacacggagtcggctccatcgctgcaacctggtcttttgtgaatgtagtaagtgcggaagatgtcttggcaaccgggaagtcaaggctgaataaagcctggcccatcatcggtccgccggaaatcatcttctccggttcttgtttaaatccgcctgctgcctctaacagcctcttgtagttcgttccaagccttacctggaagttctgaggatttgccactgcatcgcccgtcactgtgataatcttccgcagcagcggcgtggtattgcagacagcatcataaatagcagccacagtgtcaatgttgtctacaacacagcctgcgtctgccggcagcatggaagaattgatctctcttcccgttacggcgtaaatcagcgtacgctcgcctccctgcggatacttggtgagaagcggacatacctcaattctcggctcgtccttcaccatctccgtcagcttcttgatcgcttccggtttgttattctctatgcctatgattcccttggcattgtcgaacaactgaaggatcactttcagtccgccgataatctgttccggacgttccatcatcacacggtagtcgctggtcaggtaaggctcacactctgcgccgttcacaattacgtgatcaatggcagcctcatcctttggcgtcagcttcacatgcgttgggaagccggctccgcccaggccgacgataccggcctctttaataatatttctgatctcttcttttgaaagcttcgtgtaatccctcgcattaccaaaaccttcaatcgcattttcttccccatcgttctctacgatgatagactgtaccattgcgccattcgccaccagccttggttcgatcccctttaccgtaccggaaacagaacttaatacgttggcggaaatgaagcctcctgcttctgctataatctgacccttaagcacctgatcgcctttggcaaccagtggttttgcaggagcgccaatatgctgggacagcggatataccatctcctcgcccttctcaggaacgatgaactggattggtttatcctcagacagttcttttccttcataaggatgaatgccgcctataaatgtagccaaacccatcaaataaaccctctttctctagtttgattttcgcaccctggatgtgaattttttgtcatattttcgtgaattttttatcagttccagggttaaaagctatcgcgtatagtatatcataggaaaaagtttttaacaattggaaactttaagataatcgaccgaattttgtataaaaattaatacaaaatttattttttttgtaaggtctttcatacagaaacgacaaaaaaagctgccataaatttaccacagcagccctttcttcgtattttaatttaacaattatttccaccttttctactcctgcgccacaggaacccccacttttgacagggcgtcggaaattttccccgcctgcctgacatccgcctcaaacccctcgttaattacattgtgtatttttaagtaggtgcgcagctcctcctcactgaaaaccgaaagctgcttaagctttcttctgccgcactcctcatccacggcggcatgggctttatagattctccagccgtaatccgtcagaaacaggttgtactccctgttgttgtctttattgcgtttctggaacacaagccccttcttcctcagcttcctgataatctgggagctggcgctgggggttttgttcatcccggccgacagttccgaggaagtaatcccaggcgtgatcccaatccgttcaatcgtgtgggattccacctggtataaaatactgtccccgtattcatggggcatttcgtcgtaggctgccatcagacggcagcttttctccaggccgtccataatctgaagatacagctcttcttttaccaattgttctgacatgtttcctacccccgctgtttaaataggtaaaaagacggactgcgttttgcacactcctctttcacaagctccgcaccggcaaggatatgggaatccctcagttccaccctcccccgccggtccggcctctcgtatttctgttctgtaaacgaaggatctaggagccatattttcattgcggcccctccgccttcccagtccgcttccatactgagcccgtctgcaaaaagataatggccgccgtcggaaaagagaccgtgttccctgcctgcatgaatcactgcgcaccctcctgcctccagccaaagctccagtgtttcaacgctttgcgacacctccatctccaggttaaaccgctttgctgcggctcttccaagccggttcatatcggtgccgtaataattggctccggcccggatagaaagatttatacacgcttccacggaaagcctctctcccgtcaggaactccaccatcatgcagacgcagcacaggccgcagccggccctggccacgctgggatacggctccctcagaacgtctcccggattcagggtcgtaggatacggtacgtccgcataggcaagctggtttatgtatgtgacggacgggcggctcatattgcctcctgagccttaaggcttccctctgcaatctccctccagtaatggcaggcaaccgaatggccgttcccggcgtccgccaaccggggacttgacatggagcaccgttcctgcgcataaatacagcggctgcaaaaacggcatttttcgcccggattaatcggagatgtgatttcgccccgaaggagaatccgctctgtcttctgatggattttaggccttggaattgccgaaaggagcgccttggtatagggatggagctggtttctgaacagttctttggattcacacatctccaccatctgtcccagatacatgacgccgatatgatccgatatatgttttaccaccgataaatcgtgggtgataaagatataggtaagccccctttcctcctggagatcctgcatcagattcaggatttgagcctggattgatacatccagggccgatacgggttcatcgcagacaataaatttcggattcagagccaatgccctggcaatgccgatgcgctggcggcggccgccgtcgagttcatggggataggtgttatagaggcggccggccagccccaccgtatccatcagctttgccacctcacggtcataatcagccgccaaggagcatattttgaatattttaagcggttctccgataatctcactgactgtcatacgcggattaatggaggaatacggatcctggaaaatcatctgcatctcctgatgcagctccttcattaaatggcggtccggatgcgagatatctttcccgtcaaaccatatgcttccctccgtcggttccagcaggtgaagaagcactctgcccagcgtcgatttaccgcagcccgattctccgacgatacccagcgtctttccctgatccagggtaaagttaatattgtcaaccgcatggagcattcccttgggggtattgaaatatttttttaaaccttttacctcgagcagcttcgccatcttatttccctcccctgtcgtcctgccgtgcgctgccgtcaggctcctgccgcacggtgtcctgtctgttcttgttcgtgtgaatcaggtggcatttcaccatatgcccctgcacagtttccctgatgggcgggtcttcgtttcggcacctatccgtgcaatgcggacatctgggactgaaggaacatccggcaggaagattcgtgggatccggcatcaggcctgcgatgggactgaggcgctccgtatccttatcgagatccggaatggaaccaaacagcccgatggtatacggatgctccccctgctcgtaaatatcctccagattgccgtactcgacaatctcacctgcgtacataatcgcaaccttgtcacagacctgggcgacgacgccgagatcgtgtgtaatcaggatcatcgatgtattcagtttgtttttcagttccgtcatcatctccagaacctgagcctggatcgttacatccagcgccgtcgtcggctcatccgcaatcagcagcttgggattgcaggccagtgcaatggctattaccaccctctgcttcataccgcctgaaaactgatgcggataatcctgatagcgttcctcattgattcccaccatccggagcatctcctgggcacgcacggccgcttccgctgccgagcaatgagagtgcaggcgcaccacctccgcaatctgctctcccaccgtcatcaccgggttcaatgaggtcatgggatcctgaaagatcattgagacttccctgcccctcatttttctcagctcgtgccttgattttttcaggacattttctccctggaatataatttcaccgcctgcaatccggccgggcggattcggaacaaggttcataatcgccagggccgtcgttgtcttcccggcccccgtctctcccacaagtccgagagtctccccggccaccagatcaaacgtcaggtgattcaccgccttcaccacgtttttttccttgacatagtgaaccgacaaatcgcggaccgacaaaatattttcgctcattttcctcctcctttacgttttaagtctgggatccagggcgtccctcagaccgtccccgaacagattcagtccgaaaataatcatggcaatggcaagccccgggaaggtgacaatccaccatgcctttcttatgtaggcacggcctgctgagagcatggccccccattccgccgacggcggctggacacccagtccgataaagctgagggccgatgcctccaggattgccttggccacgctcatcgtaatctgtacgataatcggggccaggcagtttggcaggatatgcttcataatgattctgaaatcagaggcgccgatggagcgcgccgcctcaatatactcctgttccttaaccgacagaattgacgcccggacgattcttgcataggcagggacagctccgatagccaccgctatgatgacgttgcgtatcccgtttcccagggcagccacgatcgatattcccagaagcgtgctgggtatcgccagcataatatcaatcaggcgcatcaggatattgtcggtccgtcctccgtaaaagcctgccagggaaccggcaatcattccgataactgccgacagagtcgcagccacggcccctatcataagggaataacggctcccatacacaatccggctgaagatgtcacggccgaattcatccgtcccgaacagatgcctgccgcctggctttaaaaacttcccggtcaaatcctgttcatccaccccaaagggagcgatgaagtcggcaaaaacggctatcagcaccaaaattactatcagagccaatccgaacatggccagcctgttcctcctaagtccattccatgtctgcctgaaaagtccttctttttttatggaggaataatccggcatgccgttcgtcgtctgttctgctgtactgcccatatcctattcctccttatcttcttctgccgtttcgcggccggccgtgccggcaacagtcgccgattcagccttatccggcacggcttttgtgccggaatttttatacccgcatgaattcccgtgactgaacgctgcgcgtcgaggtatactgggatttgattctcggatctacaaaggcatacagaatatccaccagaagattcacgatagagaaggcaaatgcgataaagagaacgccgccctgaaccatcgggtaattctttacattgatggcgtccaccatcagctttccgatccccggaatcgagaatatggattccgccaggattgctcctcccagcataccgccgaaggaaattcccaccacggtgataatcggaatcagcgcattccgcagcgcatggcggaacacgatcacgacttccttctgtcccttggcccgggccgttgtgatataatcctgcctgattacctcaagcattgccgatctggtctggcgcataatggtcgcgctcgacgccattcccacggtcagggagggcagaatccagtgcagtggcgtatcaaaacccgagggcggcagcaccttgaaattaacggcaaaaataatgatcagcatcagtcctgtccagaagtttggcatggacacgccggtcagggcaaataccgtggcgattttgtcgaaaatggaatattgctttactgccgcaatcactcctgtgacaacaccgatgattgtggcaaaggagacacttaataccgccagcgttacagtggccggaaccctctggaggatctcgatggataccgactgctttgtcgtgtaggattttccaaaatcaaatttcgtcacgatattttttatgtaattgaaatactgtacaagaaacggctgatccaatcccagttcatgatggagcgcattaatattttcctgggtggcgtccatccccagcatgtattccgccggatctccgggcgtaaaatacaggaggctgaaaataatcagagagacgcccagcattacgggaatcagcgccaatattcgttttaatataaatttgctcatagaatcagtactccttcgttcgctgttcgtagcagttcagacagcatgaactgttacggacgtccgataatctcatctacaatcttctccatataatcgagggagtcctccgtcattttctttcctatctcataggtggcttttctggcatctcccagcgccccgttgagcgacgcgtcgtttttccagctccaggcagcgcctccctttacgaaggaatcgtgtgtgagcatgctgtcctgtataatgccgggaacgcgctcactgcgcaccgtctccgggcacagatagagacaggagctggtctccacctcacaggcgtgtccgttaagctttggaagtcccgtcagtccgcccagcgatatctccgagccgactgccgaccagtaagcgtcaatttcatgattttgtttcagactgataactgcgccttcaagagccggaaaattgcctccgtgtgcattcagaaacagaatcttgcgtatgccgtgctgtgcaatggatacgccgatatccaccagcagatgcatcattgtctccacctggagggtcaccgtgcccggaaaatccatgtggtgcagagacaggccgtaatttacacagggaaagaccactactttatttttgcatcgcacggccagcttttctgcgtaggccgccgctctggcggcatccgtcgcgaacgtggtgttgggtccatgctgctcgcaggagcccaccggtaccagagcaaccttgatatgttccatttctgcctctaattcgggccacgtcatgttatttatgattaatttatccattctgcttacctcccgtacctgcaggagcctttcagacggctcctgccattttaattattcgttacagttattcagtaacagtcacgccggcgaatgaaggaatatctccgggatcgcagtagaaattctgaaccttgtccgtgattacatagtttaccgtcttattggccacgcctatcatatagtactggtgatagatgtaatcctgcagctcttcatagacagccgcccgctcagccgtatcgtaagctgcgctgcccttatccagaagttcatcaatctttttatctacaggacggaagaagccgtcgcttctcgtatcaaaatctgcaagagcatgacccggatcacccgtggaataggtggccgccatgattgtgacctgattgtcgccgcggcgccctgctgcaataatctcggaagtggatgctgtggaaatattggccgtaaccccgatctctttccacatattctgggcaatcacaccgatattctgctgctcggagccgtttggaaggttcagctcgatcgtaagcccgtttccgtatcccgcctctgccagaagttcttttgccttctccacattatattcgtgtctgccctgagacttataggaaaagactgtggacggcatcacgctctcgctgaccgttgcataatttccataaaccgtctccacaagggaatcgagatccagagccagggaaagtgcctgcctgattctcacgtcgcttagcaccttgtcatccatggaaaatacaatgtaagatataccgtagctgtctcccgaaacgaccttcagcccgtctgtctcagccagcctgtccaaatctcccgtatccggatccagtacgatatcggcattgcccgattctatctccagcgccctgttggctgtctccgtgataaatttgagggtcagagtggaatatgccggtttttctccccagtaattgtcattgcgcttcagcgtgatgctggtgccgctcacccagttatcaaatgcaaatggcccggttcccacaggactgcgtccgaactggtcatcccccatttcctccactgcctttttgctcacaataccgcctctcgtggaagtcagataattgtacaccgctgcaaacggggcttttgtcgccacatccacggtcagttcatcgacggcctttgtgttttcagcgtcaaaggatgcaaatatcgaagcgctggacggctttttggtcgccctttgtatcgtatataccacatcgtcagccgtcatcttctccccattgtggaaatatacattatcgcgcagtttgaagcggatcgtcttgtcatccacctgttcccagctctcggcaagacccggaacaatatttccttcctcatcctttttgaccagtgtttcaaagatctgcacctgggtcgtcatcgccaccagctccgtattaccatgaggatcgatattagacggctcacccttcaataccacagtcacctcatcctttaccgccgcattttcagcggccgtctcccccgactgagcctgaccgcctcctccgcctcccgaatccgacggcacatcacttttacccgcacagccagaaagcaaacacagccccaaaaccattgccagaaataactttgtttttttcatgatacctctccttttctgtatattaaaattaataaataaccattcagacgctctcagaaaaatgtcagaaaaactccacccaaaacagccccatatactgagcgaactccgatacctctccccatccccacacttaaagcgcgagacaatcagccgccgcaggccagtggacgggccgacgaacttggccggagtctttcgtcccgacgaaaaccttcctttggggcggaggggaagataaagtctgcggatgcctttggaatccatcggtgcttgacgaggtattttcgagtatccattatgcattccagggagcgagagtgtgctccgcagaccttatcttcgcccacagccacaatccacaacacaccattaaaaccctacaaccaatgtgcctgttcccacagcgtcagcatcgtccccagctcctgtctggccgcctcctcaaaaagggtgtaaccccaggaaacgtcttccacaggcagtccgcccgaaataaacaggattttttcctcctcggactttcggggattcacctttcccgcagccacatcactcaggctcagcatatcctccgctttcacctttccctgatccagcagtttcagcatctggtagcttggcgcccagtcttttgtgctttctattccgtccggatgcatcttcccctcgtcgtaccagacctcatgcatgggccagtaatcgaaaaccacctggttttccatccagcattcttccgaaagctcggcatgtcccgtcgcagtaaacaggcagcccggtttcagccagtccttatcaatcacaacaggaaccggccctgccgccgcgacactgataacatccgaatcagtcaccgcttccttcaaatcctctttgataataatttctatatcgtattcttttctgaattcctccgcaaacgactccgcgctggctctcacgatatcattcagatacatcctctttaccccgggcatactgttcaggattccccttgcgcaggccctgctgataacgccgcagccgataacgcccagtgactttgcatccctgcgggccagatatttggccgccactcccggaacgcagcctgtccgcattgcgcttaacaggttcgccgacatgatggctaacggctccccggtcaccacatcattcagacccaccatcagaatcgaacggggaagccccctctccttcgggtttgtgatattcgacccgtaccatttcacgccgcagcagttgtatctgcccccgatataagccggcattgccatataccttctgtctggccctgcaaccggcatattgggaaacggcgtgtccttcggataccacagcatacagccgtggctgctctggttatagccgcccatcacaaaatccccggctcccagaagcttaaaagtgtcgtccataacctccacgcatttttttacatccagcacccctgctttgatcatgtcaggttcggataaaaacctgaaacctacctgtttccgttccataagacctcctccattctttaaattcctgcattctctcctgttttgccgtcattttcatttattagccagtgaatttctaatatgctccatcccctcttccagatatcggcgggggcatgcgatattcaggcggacaaactgctcataaccgcttccatactctgcgccgaaatttaaagccaccttggcctcatccctcattttcaggaacagctcttcctgcgtaaaccggcagcccgaaaaatccatccacatcagatatgtgctttccggcatggccactttgactttcggcagatattttgtaatataaccgaccacaaagcgtgcgttctcttccagataggccatcatctcatcaacccacgggcctcctttttcataggccatttccgtggcgcggtaagcgaaaagattgatatataagtgcatactggctgcaaaattacctaccttttcacgcagctccctgtttttgataataataattgaagatttcagcccggcaatattgaacgttttactgggagccgtgatcatcaccgcatcctcatctacatttaaaatcgagaggtggcgatgacccgggtatacaatatcgtaatggatctcatcggagataatcagcaccccgtactgtttgcaaagggacgaaagccgcttcagttcctcttccttccagactctgcccacaggattatgggggctgcataatatgtaaatactgactccctctttaaatttcttttcgatatcttcaaaatccagctcataggattcgccgttatacaaaagcggcgactcgaacagctcatatccaagacctttcactacggtaaaaaacggcgaatagacaggaggatttaccaggattttatttcccttctctgcaaccgacagcaggaccaccgataaagccgtaatcactcccggcgccggaatcagaaattccttttcaagctccagcccatggcgttcccggttccaggcaataatactgttgtaatacctctcccctgcaaatgtatatccgaacgtcatcccctcgccggaacgttcctgaagcgcctggttaatctccggcagcaccggaaaatcggcatccgccacccagaacggcatcagatcatcccggccgtagtcgcgctccattgcatcccactttgtactgtccgtatgtctgcgttctaaaagcacatcaaaattatacattctcttccctccgtctttgattatttatctgcttttatatttatactcttttatatttagcttctttatagttaatgtactaaactttaatcttatctattttatatcaccgtgtatcggatttgtcaagatattttctgtgtattttgatgattatcgataatatttatttaatagttcaacaaagcacacgacatctgactattagccgcatcttcagcctgtacaactaccgtgatagatccggaattctcttccaacaacgatatctgcagatatctgtatgctccgcgcacaggtcaccaccatcaaaaaaagacaagaggaaagcagaagctttttcctcttgtcggtaatttatactattaaattaattatttatgcaaagaatttagaccagtagccctgtacgaagatataaagcacaacgaccggaatgatataggatacataaaccctggcccataccgggaatttgatgccctttccttcattggcctctccaaggaaattcttaaagccccagccataacggcttgtacaaaacagcaggtaaacgaggcttcccaggggaagcagattgttgctgactataaagtcttccaggtcaaggatcgtagagcccggtccgaaaggtgtcacattactccagacattgaatcccagaacacagggaagggataaaagggttacggctatcatatttacaacaaccgcctttttcacgctgcagcccgtgagatccgttgcaaaggaaacgatattctggaatacggcaatcaccgtagacgccgccgcaaacgacataaacaggaagaacagggttccccagaatcttccgcctggcatattattaaacacattgggaagcgtgataaatatcaggctcggtccctgtcccggttcaatattataagcgaagcaggccggaaaaatgatcaggccagccataaaagccacaaaggtgtcaagaattgtaacattgatggcttcgcccgtcagtcttctctctttgccgatataactgccgaagattgcaagggctccgatcccgatgctcagcgtaaagaaggactgccccagggcggcaaacaccacctctccgattccagtctcttttatcttgttaaaatcaggttttaaatagaattcaaggcccggacggcttccctccatccgtacggagttaattgccagcacaaccattaacaccagaaggctgaccatcatcagctttgttattttctcaacgccgccctgaagtcccatcgcacagacggaaaagcagaatacgacacagagaaccatgaaaccgatcatcaatgaaggattggacagcatcgcattaaactctcccgccactccgtccgcatccaggccggcaaaatcacctgccgccattttgacaaagtacaggaacagccatcctgctaccgttgtataaaacatcatcagaatgtagttgcctgccattgcaaaccacttctcaaaatgccatttgcttcccttcggctccaatacgtcgaatgaaagcgccgcgctcttctggctggctcttcccaccgcaaattccataacgataatcggaagtcccaaaagcacaaggaagactgcataaatcagaacaaaggctgctccgccgtactgtccaactatgtacgggaaccgccagacatttccaagaccgatggcacagcctgcggaaatcagaataaaaccaagacgtgatgaaaatttctctctgcccattaccattctcctttataaatatacatatccctagcgtgtctgaaaatcgctttccgtcaaatatgccgcgaagcgaggcgtgcagatgacgaattttaagacatactctagctagtttactatatatttcaataaaagacaaggttttacttccgcagaaataatacccaacccaaccccgtccgctgtaccggcggcgtcctcatctgcttaactggtccccggtgttttacaggatatccttccggtactcctcgagttccctgatatacatctcaccaatataactgatcggtatttttttctttttaatatatcctatatgcatcacatcctctgtccttaatggtacggccgtatattcattaccgttcagttcccggcagataataccggagcagagtgtatagccgttcagcccaaccatcagattcaggagcgtggcccgatcatccgccttgatgatccgcttatattcccgggtgctgaatacttcctcggcaaaatagaatgaattctgttccccctgttcaaaggagaggcagggatattcctccagttcctcgaaatatatttccgtcctgccggcaaggggatggtttttccacagatagacaaaaatgccgcaggtaaacatctcatggaactccagttcattgtctttcagcactttttccagggcttttctgttaaaatcgtttaggtaaataatccccagctcacttttctggcgtttcacattgtccactacttcaaacgttttcgtctcgtggacggcaaattcgtactcgtccatgccgaatttcccggcaagccggataaacgcctccactgcaaaggtatagtgctgcatggagacgctgaatttctttttaaaagctttccgctctatataccgcgcttccataagacggtactgttccagaatttgtcttgcatagctcaggaactcttccccctcagccgtaagttcaatccccctgttggaacggcggaacagggtaaggcctatctccccctccagctccctgacggaattggagaggctgggctgtgagagatacagggcatcggcagcgcggcgcatggatttctgctccgcaactgccactatatatttaagctgctgtaatgtcataccgggtacgatcctttctgcggattttttctctcccaattatataatgcccggcgcctgttttacaagcgctctttcagacacgctatgattcaaggtagcttttccccggattcagtatgcccttcccgtcaaaggattgtttaatcattctcatcaattccagcacctccggcgacgaggcatgttcaaaataccgcttttttgccagcccgatcccatgctcccccgatataagtcctcccagttcttctgctttgctgtagatgcgcgccaggacggcagaaagctctgtttcccatctttcctgtgggatatcccccctgactacacagagatggacgttcccgtccccggcatgaccgaagcttaccatcccgattcccgtctccttctgcagtccagagcagaaggttacaaattcttcaatccggtcgatcggcacgactacatccaccggctcctggatgctgactgcctccacggcctttaccagagccccgcggattttccagacacgctttgcaagctccgcttcatccagaaccagaaaaccggacgcgccagaccggcgcagtactgtttcagcctttttaaggtcctcttccacccccgtccggctcccgtcaaaggtcagaatcaggtaacaggctgcgtcacagggcggaaacttctccccggtaaactcctctccgagccttaccacatccttttccacaaactcaaccgccgtaggcgccgtcccggaggctgacagggtatgcacacttgcgatcccctctctcagcgtccgaaagggaaccagggctgaaacggaatactccggctttggaagcagccgcagtatacattttgtaataaccgccagcgtcccctcggaaccgattaacagatttgtgaggttcagtcccgagctgtcctttctgtttctgctgcccaccgtaatcacagtgccgtccgccttcacaagttccagccccatcacgtaatctctggtcactccgtattttaccgcccgcattcctccggcattagtactgatatttcctcctattgtggactgcttctctcccggatccgggggataaaaatatcctttttcctccacataactctgaaaatcggccagcaaaacccctggctccacggtcgcggtaaatgtatccggatcaaactccagaatgcggttcattctggacaggtcaaggacaatgccgccgtccggcaccgtggctccggtcaggtttgttcctgctccccgcggtgtgaccggcagttcattctcccatgcagaacgcataataaaactaacctccgcggccgactccggaaatacgacgagagctgctgcgcccttccttctgcccatggcgtcgctcaaatatttcccatctattttatctgataaaatctgatcgcttctcagcttctttttcaaatacgccctgattgtatccgtccggacctccgtacgtatgtccggggcggcctccctatctctgcctgttccaatgctgagtttatcattcattctcatatctatctccctctctctgtccgtcgctgcggccaaaggccggttcagtccttaacgccggtcaagcgctgcagccagccggtcgccgaaagcctgcccgagctggacggctgcaatcagtaccagaaccgtaagcaccattacccctgtttcaaaacggtagtaaccatactggattgccagattgccgatgcctccgcctccgaccaggcctgccattgcagagtaactaatcaggctgacaaatgtcacggtaacagccctgaccaggccaggcgccgcttccgtcagtagcacgcggcggacaatcagccaaaatccggcgccggagcctgccgcggcttccaggaccccctgatccacctccctcaatgcaccttccaccagccttgcctgaaaagcaactgcagctatcgaaagaggtacggacgctgccagcggtccgatttttgttccgaccagcgccttcgcaaggggcagacagaataccatcagtatcacaaaggggatcgaccggattacattgacgacggctcccgatacggcattaacaaacctgtttctgaaaaaaagcggactggaagtcagaaacaggacaaacccaagcaggagtccgaacacggccgagacggccatggaaatcgccatcatctgcagagtttcaatcagcgctttgggaaactccctgcccaatatctcaaatcccgactgtatcataaccatacctcctgacctccaaaacggcggcgcgcttttccaccttggcataccgcctcatataggcggccgctttttccttctcctccctctctccctccatcgatataactatcactccgtaagggcggcggcagatatattcgatttttccgcccagaatactgacggatacctgaaactgtttcgccatattgttaagaagcggttcataagcctctttccctgaataggaaacgataaaaatttcccgctccccggtcagcagctcttccggaaccgacagttcgaaggatttactgaccaactgctttgtaacctcttctttcggatcggtaaaaagctcataggtgtcaccggcctctatgatcctgccgttctccatcacagccatgcggtcaaagagctgcctggccacctccatctggtgcgtgataaatagaatcgtaagaggatacgtttccttaatccgcttcaggacctcaatcacctcagccgtattttccgggtccagggcgctggttgcctcatcacagagcaaaatctccggccggttggccagcgctctggcaatggccactctctgcttctgcccacccgaaagctccgccgggtaggcatggagcttttcggacattcccaccagggccagcagttcctttgtcctttcctctgtcttcctgccggataccccggcagccagaagcgcaaattctatattccggcccacatcggcattcatgataagattaaaatgctgaaatatcattcctattttcagccgttcctctctgagggcccggccctttaatcctgtaatctccctgccgtcaatccttatgcttcccgaatccgtcctctgaagccggttgacggtgcgcacaagcgtgctttttccagcgccggaaggtccgactatcccgaagaattcacctgtttccacagtcagggtgacatccgacaccgcaagaaatttcttccccctgttttgaaatgtaacggatacatggtcaaattctatcatttttcctcccaccactgcggcctgtcgaaaccgtcataaaagctgtcctccgtgattgcccggctgaatgcgtctgactccaccgcttcctttaacaggctgccgatactgccttcaccctctttttcatccgccctgacggcaatcacgtttttcatttcttcctgcaaacgctccacagccagcgctttccggtaatccattccggctgcaatcgcataattgccgggaatcaggccgattgccacgctgtccaggcttctggaaatctgagccgcatccattgtcacaaattccagttttttcgggttttcaaggatatcggctgtccccgctttcgtctcgtcaatgtcattgctgatggatataacgccgcagtctcttaaaaaccgcagcgccctggccagattcaccgcatcggccggaagcgctacccggtctccttcattcagctcagaaagctcggagcgggtatcggaaaagatccccattcccagtgtcggcacattgattactgaaactatatccacctggttatcttttgcaaactgatccagatacgcctggtgctgcatcaggtttgcatcgatttccccctccgccagagccatatcgggctggacatagtcggtaaattccactatttccgtcttatatcccttctcctccagatagggagcgactgcttttgtgaacatatctccgtacgggccggcgcaaacgcctattttcaaagtcgtctgcccatccctctcctctgccttttgaactcctgtttctcctgcgcatccggctgccagaagcgccattgccaatataacccctgctgccgccagccggttcttttttaatacgcccttcttaaatgtgtttctcttaaccgtgttattcttccatgtgatctttttcatcctgtcctccttaccgctcctgcaatagaagcctgctggttactgttcacagaacagcgttttacagcggatccgcgaatagtaacgcctgctgttattgttggagcctattatacaaaaagaggcggcttctgcataatacgaattaaaaaacgggcgtgatagtcaaaaactatcacacccgccgttaccgtattgtaactgctgatacttgcagtatttatatttccatacctttacatcggtccgaaatgaatcgcctgggcaataatcagcattaccgtaccggttcccatccagataaagaacagcttccacatgaatttcatccatctgtcgtaaggaatattcgcagcactgataattcccatcagggctgtggaggtcggaagcacatagttgcagaatccgtctccgaagttgaaagcaagcactgcagtctgtcttgtaattcccagcagatccgcaagcggtgtcataatcggcataacggctgccgcctgtccgctacctgatgtaaggaatacgttgataaccgtattggcaatcagcattgccggggcctggagaaccgccggaaccatgttcagtccgccggccagcgcatgaacaaccgtatcaataatattgcctgatttcatgatgctggaaattgcgcttgccataccgatgataaaagctgcgcccagcatctttttacatccggtcaggaaatccttggagattttggacgggccgaagcctgcaatcgcaccttccaccacggccaggcctaagaagatagcggccgtctcttccatgtcccagtccatcttgataccgccgtacacaatggcgacaagggctgcaaagaaggcgaacataatcaatacttttctgaaatccatggtgccgaaggtttcaaggtcggcattttctttaaattcactggtctgatccagatcatacatcgggctgtattccggatttttatgtaccttcatcgcataacggatcaggtagatattggtcactacatagaataccgcaaaacagacgaaacggtatgcgacaccggaataaagcggaagctccgcaatcttctgggctacaatcgtcgtgttgatatttaacgggcctgtggaaaaacctacggctccgcccagaaggatgatggccgcaccggtaatggaatcaagccccatggccattgccagcattaccataatcggcgcaaaggctatgaacaggttcaccccctgtgtcgtacagataagggcaaatacaagagtcaggatcggtatgaaaatatataacttcccggaaaatctcttcgcaagctttgcaactattgcgtgaagagcgcctgtctctgttaccatatggaacgctccgccggcaaaaaggataaccagcatcagatcaatctttccgataaacgctttgacgataaaaagcggaatcagaaacggattcaccggtgtcctgtctacatagctaaactgcgtcggatcaattaccttaatcccttccgcattttcaaatctcacatactctcctgccgggataatccatgtcaggactactgccgcaagaataatgataccgataatgacaaaggtatgcggcattttaaatggtttttttgttttttcactcacgtttgtatccccctatttcatcctcatctcatcagccatcctgtcggcaaattcctgtttcactgccttcagcagttccggccgcatcacaagatccagggccgctccggccagaatcttcgcaccgtaagaaatcgcgtcatgtgcttctttgctcttcccggcatccacgtaatcctgtgaatgggaggctgcatcttcttttacaaaggcaaccctgatacaggaacccggtacgcggtgcatgatattgccaaaatcagtggagcctgtcttctctctggcgggacggattctgggcgcctccacctgagaggcattatccatcagaatatcattcagcgccaggcacggaattttgctgtcaattcccttttcctcaattatctccacttccgtctccgtcatcatcgcagcgccttttaacaccttctggaaccgttcaatcaccgtatcgagataattgcggctgtaggaacggacatagaagctggcctccgcgacagccggaacaatatttgccggtgtgccgccacagttcacaatggtatagtgcatctttacatcgtccgcaacatgttcccgtaaaaattccactccctgacaggccataatcagtccgtccagggcgcttcttcccttctccggttttaccgccgcatgggcgcttacgccgtggaagacaaccttgaacctggaaagggccaggctcttcacatccacctgggttgcaccgctgccgtgcatcatcagagccacatccagctcttcaaatgtacatccgtttttcagcatcatgattttgccgctgacactctcttccgccggagtgccgtataccgtcactgtataattcccgtctgcctccgaatttttgagcgccgctgccgctgccagaatggacggcccctgaagctggtgcccgcaggcatggccgatttcaggaagcgcgtcatattcgcagagcaggccgatgtttgggccgccgttcccatgatgatagattgcccggaatgccgtttccacccccgctacaccgcgctccactgcaaaaccttcctgttccagccagtctgtcagcagtgcgaacgcatggtactcattcagccccagctcaggatggtcgaaaatatcatcagacatagctgccatctgtggggcaaccgcatctatgtaccggaacattttctctttttccttcagcataaaaatacctccttcaatctgatacattcagtatatcggactttagaggtatttgtataatttatagtttttattatttgtattaggaaaatatatattccttcccctgctcactgataagctctataaaacgctgcatgtactccggcacaaacatcccctgccggtaaccggccacaaacgccgttttccttggagattcacccattgtatagtaattcacctttttccggtacttcatatttcccgcatagctttccctgttaaagctgattcccagcccttccgccgtcatctgaatggccgtctcaatattccggatcacctggattttcccgggatgtacgcctgcatccttcagggccgcatcgacatcggcgcggatgctctggttgggattctgaagaatcaggttttctccctccagccagttgagatccaggtttctgtagcgggaaccctccacatatacggccttctcattgagcggatggatctggggaacggcaattaatagctcctcctcaaacaaaacctggtactccatatcttttctgacagaagccgaattcatcagcaccaggtccagttcataccgctccagcatctggctgatctcccacatattgccctcccggattaccacctcaatgccgggatattcggaggcaaatttaaagagaaccgggggaaggagccatgtttcacggcgcagctgcactccgacccgtattttccccctcttgttatcccgtatctcagccatggcctcgtcgaattcctttttaagctccagcatctttctggctttttccacgtaaagctccccggccggcgtcaggacaaaccgtttgcccgccctctcaaaaagcttcgtgccaagcgacttttccagattattgatatagatactgagggccggctgtgaaatatacagcctgtccgctgccttcgtgatattgccgcattcggccagtacgcatacataagtttgttctttcagattcatgccgcatcttcctttcccgttccgcttaaatcccattatagcacagaagatgtttttataaaacttatatattttttattattattttattttttatatagatatgtcattctcaattactgctcccgccaggtttatatcggtgaccagcacattgattaacccggcacgtaccgcccccaggacggccggcgctttatgcctgcccagagccgctccgatcgagaattccgttctgcggacggccgcaagagaggcgcctgttactttccggttcagaggaaagcaatccgtattgccgtcagcgtcaaataaatatccgcagcagctgcccgctgcctcccgttccctatcctcaggctcctggtattccttccatatcttgctgttcttcagcaggctggaggtcgcactgactccgctcagcagaaccttcatctgttccgtccgcttcactgcctcccttatgaccggctgtctcataaatacttcgcggtcttcctcgccggcagcgtagaccggcatatgaaaaaggctgacatccgcttgatacaggccggccaccttccaggcgagtctctgggtatcaagctccggattcatcaaaccggcgcttcccgtcagcgagacgatatgaaccggcagcattctgtctgcttccattctgccggctatcgtggctatcgttttcccccaggctattcccagcgtcacgcccggctccagcaatgattttaccagcccggctcccgcttttcccagtccggccagagtctcttcatgggtaagacggctgttatctatcaccactgcgtgcttcattcccagacgttccctcagctccttctccagtccgccgtcccgcttcacaggcgtatggattttgatttccacaattccccggcgggctgcctcctgaatatactgcgccaccttaaaccggctgattccgaatcgttctcctatctccgtctgatttcttccttccatataataaagcctagccatctcagccatctgctcgctctgaaattccgtattcattctattcgctcctatccggtctttgcagccgttttccggcagaaacggctgtaccctaatccattttaacaaatgtgaaatattttcacatttgttgactttgtcttaccgccatgttaccatattcttaaaagaatggcaagtacacaaaaaacgcatccgaaaaggaaggtaaaatttatggttaaagagcttctaacccccggaaagataggggaaaccacattaaaaaaccgggttatatttccctcgatgtgcaattactactgcgatgacaaggggttcgtaacagaacagttaaaagagtatgtcagagccagggccaggggaggtgcggctatgattattatgccggggagcccccatggaacgccgggcccggcccggcccgcgctgtcctcccccctatacctggacggctggaaaagcctggcaggtatctgccattcgtacggatgcaggctttttgtacagatacatcctgctaatgcccaggcagaacgggatcccgcactgctgctgccggataacatggaaaaggactatattctcaaattgacggagagctacacgcgctgcgcccttgccgcaaaagaggcggggcttgacggagtggaactgcacggcgctcatgcccatgaaatcgctcaattcctttctccctattataatcaccggacggatgaatacggggtagattatctgggacgcagcaagctctaccgtgatattgtctcgtccataaaacaagcctgcggcagggaatttccggtaatctgccgcatcagctccagtgaacggattccaggcgggcaggggcgcggcattgaggaaacagtaaagatcgctccccttctggaagccgccggagccgatgccatccatgtttccatcggaatgccgctctcagagcaatatatctccgccccgatggatgtaccggatgcctttaaccgcggggaaattgcatgtgtcaagcacgccgtccggatcccggtcatcgcagttggccgtatcaattcaccggagctggccgaagaactcctgagagatgggacggccgattttaccgcagtcggacggggactgctggctgatcccgattttgttaataagataactgccaaagaacccatctgccggtgtctcggctgcaaccagggctgccgcaaatccatcaccaagaaggccatcttctgtgtacagaacccatttacgggcagggaagcgtctctccatcccacatacgaggaagggcttgaaaacaggcggattctgataatcggagccggccctgccgggcttgaagccgccaggattttcgccatgcgcggcgcccgtccggttatctgggaaaaggaacacattccgggcggcctgatcaacctcgccaagcagcctcctcataaagatgcgatggaacgaatcatttccttccgcctggaaatgctgcaaaaggcaggtattcctattcttctgaatcaggaggcagccccggaaaatatatcggagtttcatccagatctcattattctggcctgcggcagttctccttccgttccgcagattcccggactctgccttccggacggacagccaaaagagaacatttatcctgcggaccgtctcttccgggacccggcgctccgggtgaaactccaaacagacggacttcccgttgccgttctcggcggaggcctgatcggtacggaagcagccgagactctctctttgcttggccttcctgtcaccgtttttgagcttggctctgaaattgcaaaggatttgaataaaaaccggcgctattttgtcatggaacgtctaaggatgggacgggtcagcctgttaaccggtgtacgggttacaaatgtctgcctgccccgcgtcacctgccggaaagacgggaaggagctggacttcgacggttttggtacgatactttatgcactgggaagacaaaatttaagctcccgccgtttagaggaaaacttaaaaaaagccgtcccggatgtcccaatactctccataggagatgcgagacagccgggaatggctatggacgcgattgcagacgccgccttgacggccgcaaactttcatttttaaatttaacagaaagtgcaggaaacggcattttttgccgtttctgtgcatcgcggagcgtgttactgttcgcggagctgcgctttttcagcagggccgtgaatagtaacgctttctgtcagcttatcgcttcggaaccaatattataactccactctccatctgaatacactgccgttatatcagacaggtaataggctcccgtaccgcttctgtactttttggcattacacttaaccgtatcgccctcagaagaaatctcctcgatcgtaaccaggagcccgttttcaattcctttctcccgatccagaatcccggcttctgccagttcctctgctgtcgcctgtgagccgaaaacaccgaaactgcttccgcccatataggcaagcccctctttctctgccgccgtcagggaagaaacaccggtaaaatcaaagtagcattccccgatcccgtcatttaaaccggaatccttcttggccagctctttgataatctgctggtaaaggagcagttccctgctgccggtccggcccgtcagcctcaatctgtcataagaaaactgccccggatagctctcctgtaccatcccgttccatgtaagctccacgatcatgcccggttccaaatccgacacctgaatcgcattcccttcttcatcctccagcaccgggccatggcctgcagtataaagtccgtatgccgtatcgacggcgcttaccagaaggtatttctccttcacctcgagaatttcaaactgcctgccgttctgggaatatgacggcccgtccgcatccccgttctccggctcagtctctccatccccgcttaccgtctgcgtttcattctgtactccggccgccgtaccggccgtttcattcaccgtacctccggccgccccgctgctgccgcagccgtacagaaataccatacagcctaacaggatgcagcccaggctttttctcactgacgaacttatcataattatcctcctcacatcgttatctaagtacccacattataccagagacagcgcggggatgtattacctttcatttaatgttttattacaaccttttgaccctggtatcatgtcatgatgttggggtcaaaaggtcttttgccccctttgataccggattgccccgcacttaacgcgggagacattcagcggccgcaggccggcggacgggcgatacctttggccttgagtctttcgtcccggcgaaaacctgaccttggggcggaggggaagataaaggctacggatgccgcctaaatccatcgctgattagcgaggtcctgtcgagctgtcgagtagatatgccccttacgtggcatacccctcacagaatccggacgtgcggatttcccgcgtccggctctttataaggttcattgttcgtcagttcaagcgtatatactcacatagattttaggtttcgccaatgggtgctgcttcatcatttccctgaacccttcccatgtataacttttcttctggctcctccggttcagccacttgtacagcgtcttttctacctcccggtagaacaggccgatactccggctgttatcggtcagtccatagtaatggtagtatccaactaatatctcattcagcttcttcacctgcacggaaatttccttatgacgctcctttttgatttgcgcatggatttccctgcttttcttttgcagcttctttctgctggttttcctcttcacccggaactttccgttcctgctttctgaaacgtagtgtgtaaagcccagaaagtcaaaggttcccgtcttctttccctcacgctctgctctttcttttgcaaaacggccaaattctatcagacggctcttttcttcttccaggctcagcccgaagtgctccattctatgtttcaagcggctatagaattcttctgcctcctctttatattggaaacaggctacaaaatcatcggcatatacgattaggccacagtatccccgcatcttcggcttaactttttcttcaaaccaccataacagtacataatgcatatagatatttgccaggatgggcgaacacacacttccctggccggaaccctccggactttcctgatacccataatcctccatgattcccgctttcagcgtccttcttatcagacgcgtgatgttcgggtctttgattcttgattccacaaatctttctatccatttatggtccagatgattaaagaaaccctggatatccgcatccagcacatagttcgttttttctctttccagcatctgatttagcttcctcagcgcctgatggcagcttcggcctggtcggaatcccatcatgttgtcataaaactgtggttcaaacacagcctccaggatttctctcagtccctcctgtaccagcttatcctcgtagcagtagatgctgattggcctggtctttccgttttctttaggtatctctacctttctggccggctttggcttatatgcctttcttttcaggctttccaccagtctggccagattttcttccagattcttttcgtagtcttctttcgttattccgtcgattcctgccgctttctttccatccatttgttcgtggcaccttttcagcatttccttattaatcagatgcccgacggatgtgaataccagctccggttgttcgcttgataactgcgatattctctccaatttcgtttccatcataggtctacctctgtgtatagttgatgtttcctctttgatattgccttatatggcagggctttgaggattgatgccctctctcggcttccctccggcggcattacccgctttctccggtactatccggccatccgactgcctgcccccccttttgccttcctcgcgtccggcatacccatgggaacacacttcccacgggaggggacaggctctccccagttgacgtgatatcattgtgtaacgtggctggctctcagacaccgcggcagtgtgtgaaatctcaccattgcgataaacccacctgttgccttccgctatgctaaaagcgtcggcctgccggactgcatcgatttcggtactctatcactttcagccctgttacctgactgtctacgcttagaaggcagcattactgctaccgactcaagactcgctaccggtggtgtggttagcacctttccggacaggatttccacctgttaaatatcacgccctttctgggcgcactagcagcgcgatgcatttcacagagcgggagtgtgctccgcagactttatcttcgcccgcagccccaaaccgcgataatcttcccccgggacgaaagactcatatcccccccccgtccgccgaccgttccggcggcgtcctcacctgattaactatataacattgcctgtgaacagtaacgttccgggaacagttatccggtggatcaataactgcccgtacatgccgggtatatcccagcctgcacgggcagtatatttcctgtaaatgcaaagacctgtctgaacggttacttatctgctctcttccacaaatcttctgatattggaagcattgacatatttcttcacttctccgtctcgtcccacctggaccagagtcggcgcctgcattatgccaaagcggtcggaaagctccggattctcctccgcatccactacctcatactccctgtcctttaaaaattccttagccatgcggcaattgggacaggtttttgtggtaaagaggtaaattccctctttggcgccgctctcagcccggtctgcgcttttctccggctccaggacaaacgttgttccgtttttgagaacggagcgtgtgatatcgtaagactttctgtctttatattcctgtgtcttgccttcgttccagttctgtaccggacggtagtaaccggtaatacggctgtatacctccgcctttctgccgcagacaggacaggtaaaatgctcccctatcagatagccgtgatcctggcagatagagtaggtcggcgacaatgtatagtacggaagtttgtaattctcggcaatcgtcctcaccagcttggatgccgatttccagtcgggcagcttttctccgaggaatgcatggaataccgttccagaggtatagagagtctggatttcatcctgcacgtcgagcgcatcgaaaatatctgtcgtatatcccaccggaagatgggagctgttggtataatacggcgtttctcccggttcacctgccgtaataatgtccgggtaacgctttctgtcatgcttcgccagacggtaggaggttgactcagccggtgttgcctccagattgtaaagatctccgtaaagctcctggtaatcggccaggcgctccctcatatggttcagcacatccttcgtaaaagtctgtgtctcctcatgggtcatgtccttccgcagccatctcgcattgagtccggcttcgttcatgcccaataagccgatagtggaaaaatggttggcaaaggtgcccaggtactgtttggtatatggataaagcccgttgtcaagcagcttggtgataacttcccttttaattctcagggagcgggccgcaatgtccatcatatggtcgaggcgtctgtagaagtcctcctcatttaccgccagataggcaattctcggcatattgattgtgacgacgccgacggaaccggtactctctcctgagccgaagaaaccgcctgtctttttgcggagctcgcgcagatccagcctcagacggcagcacatgctcctgacatcactgggctgcatatcgctgttgatataattggaaaaataaggcgttccgtattttgacgtcatctcaaacaggagacggttattctccgtatcggaccagtcaaaatccttggtgatggaataagtcggtatcggatactggaacccgcgcccgttggcatccccctcgaccatcgtctcaataaatgccttattgatcatatccatctccggcttgcagtccttatatttgaaatccacctctttgccgccgacaatggcgttcatctccgccatatcctccggtacggtccagtccagagtgatattggagaacggcgcctgggttccccagcggctcggggtgttaacgccgtagataaatgactcaatacatttctttacggcatcatatgataaattatctacttttacgaaaggtgcaaggtatgtatcaaaagaggaaaatgcctgcgctccggcccactcgttctgcatgattcccaggaagtttaccatctggttgcacagtacggaaaggtgtttggccggtgaggaagtaatcttacccggaatgccgcccaggccctccgtcagaagctgctttaatgaccagcctgcacagtaacccgtcagcatggacagatcgtgcagatggatatccgcttccctgtgtgcctccgctatctcatgatcgtatatttcagagagccagtagttggcggttaccgctcctgaattgcttaaaataagtcctcccacagaataggtaacggtggagttctcctttacccgccagtcctccacctggacatagctgttcacaacatccttataatccaggatcgtcgctttcatgttacggattttttctctctgctttctatatagaatataagccttggcaacttccgtatagcctgtctgttccagcacatgctccacactgtcctggatctgctccacgctgactttcccatccgtcattttggattgaaaatcggctgttacgcggagagacagcagttccaggatctcctggttgtagtcattcttcgtcgccttaaaggccttcttaattgcattggtaatctttcccagattaaagtccgccacttctccgtcacgctttatcacgctgatcatgttccttactcctttcattcccatcctcactagggttcgtatccaattatagcagatggcataataaaacacaatatctggtttcataatatttagaataccagatattgtagtataatggttcggatgggggagatttaattaagcaggtgaggacgccgccggaacggccagcggacggggtggtggggtgtgtatatgagtctttcgtcccgggggagattgtcgtggtttggggctgcgggcgaagataaagtctgcggagcacgctctcgctctgtgaaatgcatcgcgctgctaagctcgacaggacctcgctaatcagcgatggatttcaatggcatccgcaaactttatcttcccctccgccccaaggtcaggttttcgccgggacgaaagactccgccaagtatatcggccccgtccgctggcctgcggccgctgattgtctcacgcgttaagtgcggggcggaccttgtcgcagccactaagcgcttccgtgtgcgggaaatacgataagccttcaatgcgcctttataaaagaattgcgctagatttgatatcaacctgccggaaatacgtagtggccgcgacagggtcctccccatttaaggttagagacaatcagcgcccggaacggaccatgtccggtgccgcaaaaatctccgcctgagtcttccgtccccggcggaaacctgagcgggggaaggaggcggaatcaattctggaggggacatggaagcccatccgtgcttaatgaggttttttcgaatttagcacggctatgcgcttcgaagagtgcaaacggtccccgtaagaattcattccgaccggattcccccctcacgacaccctccaaccggggacggaagactcagtcatccccctcgccacaccggacatggtcctttccggacgcgtcctccaacctcagttaaatctccatatactcaggcctcagccataagtccggcgtaaagctctgtaggcacatatgccgtgaccaggatcccgtcatcccggtactcctccgagagcagctggccgaatttccggattgtctgaattttcccggcatccttataggtgtacaatttttccagaaaaatcttgcgcccccggagaatcgtctccagaatttccgtaagttcttccaggccctcgcccgttctggcggaaatcttcacctgataatccgactgcagatcttttaaaattacctcctgctccaggcagtcgattttattgaaaacagtcacaattgttttatctttaatctccagcttacgcagcgtctcatatacaatatggatctgggaatccatctgagggcttacacagtccaccacatgaaggatgatatcgctgtacctggcctcctcaagcgtacttctgaacgcttctatcaggtggtggggaagctttctgatgaaaccgaccgtgtcggtcagaagaatcttctgtccgctgggaagttccattccccttgtggttggatccagtgtggcaaagagcttatcttccgccaggattccggcccccgtcagtttattaaggagcgtcgatttgcccgcattcgtatacccgacaatagcggcggataacgtataattccgatccctctgctttctcgcgacctcacggtggcgcttcacttccaaaagctctgctttcagctggccaatcctgtcgtgaatcagacggcggtccacctccagttttttctcaccaggcccccttgttccgattccgccgcccagacgggacagggaatttctaagccccaccagtcgggcagccctgtatttaagctgcgccagctctacctgtatcttaccttcgctcgtcacggcgtgggacgcaaaaatatccagaattaccatggtcctgtccataaccttggtatccagggcattttccaggttgcgcagctgtgccggggaaagttcatcgtcacaaatcaccccggtggcgcccagctcaaagacgcgctccctgacctcttctatttttcctttgcccagataggttcccggatgaatcctctccctgttctggattatcttgtccaccgtcaccgctcctgccgtatcggccagttcctcaagctcatccagggactgtcttgtatcatcctcgtcggaggtgctgaccgcaatcagaatcacgcgctcctccagctcttttaaatcaatcagttccgccatgctacctcctgtaaccctgagccgtgcaaaatatcacgttttccctaacggctctccaaaaatgcaatctctttttccagctccggcgtggaaccgtactttgatacatagtttctgaacgtttccagagcttttccaaaatctcctcttttctcatagaccgcgcccatgttgtacatcatctgctgaacctgttcgccatcccccagcgctattccctgctcaaaataggaaaccgcctcatcaaaccgctctgccgccatcatgcagagtcccatctgattatatatttccggcccggatatgccgctctcaatcgcctggctgcaaaacccgacggctccgtcataattaccggccgttctgtatgcatccgctatggaagagactgccaccgccgctccggccggagcttctttcctgtctttcgccgcctcggctgcttttgcataatcctccactgccgtgtcgggatttccggccatggcctcggaagcggctttataatacagatactccggttcttttccgtccacatccgcaaggatgccgtacgtatgcgccgcggcctcgtaatcctccagcataaattcagcttcgcccctgtatttcagtatatccagttcaaaggcatttactactccgtccgcttctttgagcgccagatcgaaggattccactgcggacgcataatcttcattttttacctgttcaattcctttaagcctggcctctttcgccgcctttgattccccgcagccgcccagtatcagggcagatgccgtaatcaccactgtaagaaccatcgctgctcgtattctcattcgtccgtacctcttaaatttctaaacggcggctccctctcccatctgaccggggatgcgccgctgcctgtcagctcctgccggtgcttccgtgtccgcctctgtcctcatgtcccagttccggcgcttcctcaaattcaattgccggctgatgttccatgatacggaactggcagatccggtcgcctgtatgtatcgccgtgtctctcagggcgtaagccgggaaaaaccactggtcattgtcaccgcagtaagtctcatcgatcactcccatatggttcgtctggataattccaaagtttttaaaggtgctgctcctcggaacaacgtgggcctcgtatccccgcggaagctccatggccaccccgagaggaatcagggcaaattctcccttttttaattctacctcctcagccgccctgagatcaatccagtcggattttcctgctatataatcgagtttttctattttgtcggtaaagtatttaattctgattctcattttttctgtctccttttctctgcagtgcagatcgattatatcattcttttggactgcggtaaagtttttccggttttagttaagcaggcgggaacgcctcattaccgttcacacggctgtattccgcgcacaggccaccgccttcaactgaaataagaccggcaggacatgccggtcttacagagtaaatctggtttaattttcaaggctgagacaatttcccggtccgttccggacgagtcacccctcttcagcttaaagaacattcatgaaggttgtaagcaccatcgaattaaagaagtcgacaaacaggctgcctacgagcggcacgatgaagaatgctctcggcgccggaccatatttttcctgaagcgccctcatatttgccatcgcgttcggcgtagcacccatgccgaagccgcagaacgcagttgtcatagccgcggcctcataatcgcggcccatgatattaaataccgcatagttggcatacaggaacattaccacggtctgaacaagcaggatgacaatcatcggaagagccagcgcggctaactgccacagcttcaggttcatcatcgccatcgccagatacaggttcagggagagaccgcccagcgcatcgatttcttccatcggaaggtcggtgttcttcgcatcccatatattacggatcgccgccgcacagagcattgctccgatataagcaggcattgtaagtccaacatttttaaagaaagtaaagataatcgtaccgataccgattgcaactgccaaaaatgcggctgcattggtaaatttctgtccgtcgatgggagatgcagcctcatccactgcgttgccttctgcctttgccgttgatttaaggccaagcttctcaacacgcgcccttgcaatcgggccgcccatcatacttcctgatacaaggccatatgtagctgctgccagcgcgaccgtaagcgctcctgatacgccataggtctcttccagaagaggcccgaaggaacctgaagtgccatgtccgcctaccagcggcatggatcccatacaaagacctaaaagcggatccaaaccaaatgcggctgccagtccgcttcctaccgcatcctggataatacacattccaaccgataatgccaggaatatgaatacctgaatgccgccctttttcaaaagccggaaacaagcggtaaatcctacactacagaagaatacggtcatcaggatcgtctgaatcgttgtgtcaaatgagaactccaggactcccgccccgtaaagcgccaaatgtaacagtgcaaatacaattcctcccgctaccggtgccggtatacagtacttgctgagaaaccccagcttctttaccataaaccttcccagacaatagacaagtgcccccaacgcacaggcctgatacatgtcaagctgaatagtcatcatactaactcctccttctcacttacgtttgatgtaatcatttttctcccgccactacaaaaagctacagaatattacaccacttatccgttaaggatatgataaaggaaaagcccgtatatcaaacatttgtttatcgttttcttaacttcacttaacaaatctgcattcagaaggcatttcagcgtaacagttcagcagcatttaccgtcacgtcctcctccttctcaaatatgaatttatacagtgtctggtacaggcggtccgggtcgataggttttgcaagatgtgcattcattcccgccactttactcttttctatatcttcatcaaaggcatttgccgtcattgcgataatcggaatatacgccgcatcggaattgctgagatggcggatgctcaccgccgcagtcagtccgtccatcagcggcatcctgatatccataaggattgcatcataatagccctccggggatttgctgtaaagctccattgcgcgaagcccgttctctgccgtttccacaaaaaagcccttgttttccagcagcatgaccgctacctctgtattgatggcgttatcctctgccagcagcacgcgtttcccggcaaaattatattccgtcttttcttcctcccggcagacctgctcctccttctctcccagggccttggtaaaggcagagaccagggatgacttgaacatgggcttgctcatcagcagattcactcccgccatcttagcttcctgttcgattgcgctccagtcataggccgttatgataatgatggtaacatcgggaccgacaattccccggatccggcgggccgtctcgatgccgtccatccccggcattttccagtcgattaaaatcatgtcataatatttcttattttcgaggagggttttcaccctctccacagccttttgtccgctgtccacccactcggcggtcactccgatttccttaagcgtcacgatagcgctctcacagacagccacatcatcatccacgaccagcgccttcaggctggaaaaatggcattcatgttttttctggcggtgccggagcttttcatcctcggtaattcccagcttgacatccacggtaaactctgttccgagtcccttgatggagcgcacggtgatttttccatccatgagatccacgatgctttttgaaatggcaagtccgagcccggttccgccgtacagcgacgttgtacccgtggattcctgggaaaacggatcgaatatgtgaggtaaataatcttcatccattccaatccccgtatcattgattacaaagcggatcaccgcatcatttttcattttccttttaacggctgcggaaaatgtgacttttccgccctctctggtaaacttgattgcatttcccagaatgttgataagcacctgctggagtttcattgcgtcgccgatataataatcgtccagcaccggatccacaatgcattcatattccacatcttttaccgcagcctgggaataacagatggaatttattccgttcaaaaattcctctgtcggaatcttgtcattcttcaggagcattttcccgctttcaatccggctcatgtccaggatatcgttgatcagggaaagaaggaatctggatgaaatcccgattttagaaatacagtccgccacctgctcgtcatttcccagcgcctgggccgcaatggcagtcatgccgatgatggcgttcatcggcgtcctgatttcatggctcatgcgggaaagaaagtccgactttgccgcattggcctgttcagcggcaatcagcgcggaagcaagctcctccttctgcctctgttcccgccgcgcgacgtccgtcacatcggtacgcgtgatacatactcttcccagctctttgctgatataaaacgcctgatatcgtttaacccgcaccgatccgtcgtcctctttcaattcgagtacaaagctgtaggaatcctgattttcaagctgttctttcatgtaagtaaaattcatcttggccagatactcttcccgcgccgcttcatccatgcaccggtccgctacattccggagcgcctccaggtattcgcccttttcggagaccgtattggtcagcccatgtttgaaattgataatccgccggctgcctttaaccatatcaacctctgcaatggcatcataatccagggaagcgattgtacctaaaagctgctcctggagttttgcctccgtgatatccttagtataaaaaaatgcaatgacatcccctgtttcgggatgcaggcaggagctgaatccggtactcccccagaacaattcccctgcttcgttcctgcggaggaactcaaagctgtaattaacctttcccgccgcataatccgccaataccttcttccggttcagcgcgcaaagaatattccttccatattccgcgtccaccgctgatgccgccagattttctataatctcatcgtaggtttcaccaatccctgcgataggcaccgcagtgcttgaaagataattctccacccggtttttgctgacattcaggcggccctgaagacagcctcccactgaagaaatctctgcaaaataagacagctccttttcgtaaagctctctcacatgcttctgaagctgtttttcctcggtaatatcgaggcagacgcaatagaaatgcctctcaccctgcagttcggagaacagctgggccttgaccgacacccatttcacgcttccgtccttgcagacaagccggttttcattatgtatcgtatttccgtgcagcagctggctgctcagtttgtcagccatcacggccagatcctccggatgaatgactgccgacatccggttccccatggcggcaaactcttcccgggtataacctatatattcaaacaggccgtcattcgcgtcaatgactgagtaatccgggtcaaagcggcagcggaagacagcgccgggtatattgttataaaggttcattacctcctgctgtgcgtgtttctgtaccgttatatcaaggcaaaccgaggagatggcaagacggccgtcctccgcagtcaccactcttcccagatcgtgaacccagatataagaaccgtcctttttcttcatccggtattccaccacataccggtcattctctctgatctgggactcgacctcttcatcgactctccgcctgtctcccggatgcatacagttggacaccagtccgccgatatcttcgacaaactcctcctcactttcgtagccgagatagtttaacatctgcttattgataaaataaaaggggaatccctcgctgatatatccccccatcattccgccgggtacagactcgttcagcagttcctgcctttgtctggcaatgctttccaccacaagcgtcagaggataatgctctccctccctctggctgctgcccggctcggcaaaatgaaggctcttgatccgccagccggattcttccctgaccattgtgaaaaagccccgcagaaaccagccgtaagtcgaattcttcaaactcatgtttaccgacagattatacacattctctgtaactgcctgctcataaatggcggaccattcacagacaaacggttccggtatctctctgatatcctgatgaagatattccctcatctcatcaattcccctggcaaactcattgttaccggttcccacaaagtcaatatcttccgtcaaaaaacgggctgctccctccgggtcccgcaattcaaaccatctgtggcaaaactcctgtattgtttctctgattatatttccgttatccatctgccggcattctcccttttatatactttccgttccgctcccctttttcaggaattatgtcgaaataagtatatcattgataccggtataaatcaacggtgcccttcacaaagccttccccggccagtgcacactgccgtttccgtttattcctgatgaagaatcaccctctttgcctccatgcttttctttacgcggattacgcgctgatttgaacttcctttccatttcagtgagctgtccgccagctcttcctcaaaccggccgtctaccagaacgtctataaggccgatatatggaagatcgtttatctcttcccaggtatatcccgtatagagccatatggttttgtccggaaactcctgcttcactttcctgataagccttcccgtctcttcacggtttccgggatagagcgggtcccctccgctgaatgtgatccctgaaacatagcctttctcaagctcctttgcaatctcctgccacgctgcttcatcaaaaggtattcccccgtccgcatcccaggtaaccgggttatggcagcccttgcagccgtgtttgcagcctgcggtccagagaacaacccgaaggccgtccccattgagcatatcgtcttttgtaatattatgataatgcatttctctactccaatctgtcagttccgttatcccgcccgtcggctacatggatttccgttccgctatctccgccattttcgcctcatttaagcgtgtatccccttttacacgggaataactgaggtacccgttcatcctgtctattttcgtcagattgctgctgccgcaggccgggcagacatccatatccagctcggaatggccgcagtcatcacagtaggaaagagaaagattgactccctcataaaatcccatctccatcgcacggcgcaccagtgtcctcactgcttccaggttatagtcgatcggatattttacatactggatttttcctccgtttgacagctcccagaaacgatattccagattctgcttctgaatcggggagatatcctccgtcacgtggcagtggaaaccattgctgacatactccctgtcggaaacattttcaatgataccgtattttttacggaattgcttcacctgaagcccgcagaggttctcggccggcgtcgcataaattgcatacaggttgccgtcggccttcttaaattcctccaccttctcattaatatgttccaaaacctccagtgcaaagctgccgtcctccaccagagacttcccgttatagagctgctgcagctcgttaaatgcggtaattccaaaggaagccgttgccgtcttaaggagcggttttatcttgtcatgcagacccagacggcctccgtaaaatccgccttcgcagtaggccagcgggttggtggaggccctcatctcgcccagataagcataagtccggatatgaattttccggatcagctccagataataatcaagcacctcataaaagctgcggctctcctgccttgcctttgcaagaatcattggaagatgcaggctgaccacgccgatattaaaacggcccacaaacaccggctcatccttatcatcggccggggtcatgccgcccctctcaaaccagggggataaaaatgcccggcagcccattggtgaaataatttttccgtattttttatacatgccggcaatatatccctccccggtcagagagagccagtccggatacatggtttttgcagaacagctcagaccggcttcaaatacatcctccagctcccctcccggcccatgcaggttttcatcatacagaaataccagtttcgggaacaggaccggttttttgcagccggccctgccctcaccctttttacgtacctccagcatcgtgattgtcgccatttttgcaaaacggcttctgcccgtccctgcggtcattgtgataaaaggataatcgccgcggctggaggaaacagaattaaatttatattcccatccctggaagccctgttccatatcgcgtttgatatcggccatggccacatcctccgccttccggcaatcaagtcccaggcccctgtatttttccacgtatttcccataagacttttccgcataaggagccaggatttcctccacgtttggcaccgtaaaaccgccgtactgctggctggcggcgctcaggacgatatcgccgattacatcgaacgccacatcgagagtcttcggttcattataccagaggttccccatctcaaagccgccgctcagcacgcttctgacatcgaaaagacagcagttcatcgtatcgcgccgcgccgacatgtcatggatgtaaagatatccgtcgcggcaggcctgcagttcctccaccgtcataaagaacttctggtaaagcgatttattcagttcattgaaaatcaggctccgtttcgttgagaccagggcgctgtcggtattgctgttctccttatctccgatatacatgatagactggcttttcttatatacatcatccagcatctgtacaaaatcctgtttgtaattgcggtaatcccggtagctcttggcaaccgccggattcacccgttcaagcgctccctccaccagattatgcatctggaagatcgggatccggttatcctcaagcttctccaccttttcctccacaaaccggcagataaatgtgatctcgtcctgagaaaaccggatcattgccctctccgccgacttatgaaccgccactaccactttctggatattaaaatcttcccttgtcccgtcttttttgattaccttgatctctgaacccgtcatcctgctctccttttatctgttgtcctgctcctgtcccgctgccgggccttttattccgctgaaattacggtttataactatatgtagatatttcatcccgtatccatctatatacggtgtcgtttcaaaaaactcacggtacttatcctatcattcccagcggccccagtcaagcaaaaaaagaatgggcggcctgccgggcataccggcgggagcgctcatccttttaatccatattttcacaggcggccgcagcctccataattccatcctcctgcccggaagaatcttcctgcagtacgccttcgatcttaagctcctcctccacctccaggcggaactcatccacccgtccagggtttatctccggcagctgctccgtggagcccacgccaaaacggcggagaaattcttccgtcgtggcaaaaagcgccggacggccgggagcatcgagacgtcccacctcgtagacgagattatattcaatcagccggttgaccgcatgatcggatttcacgccgcggatcttctcgatctccagctttgtaatcggctgcttataggcgattatggaaagcgtctccaatactacgtccgtcagtacctgttttttgggggcggaagccacctgtatcagattttcatagtacttcgccctcgtgcacatctggaagctgtcctccagctctataatctgcatgcctctctgttctctttcataccgttctttcaggcgggcggccgcatccttcgcagactccacatcgcggcccagcgccgctgcaagctgccggacatctactgacttacccattgtaaacagcactgcctccacgattgcttcgtcctctgaaaataccatgttttcctgttccatcttttatctcattcctgttcttcaaaatcctccaggccatccagcttcagttcgccttcttctccttcgggttccagagtctctatgtacatgtcgtcaaataacgcttcctgggtgagcgcgatctttcccattttcatcagctcaagcaccgccagaaaggttaccacaacctccaggcggcctgtctgtttttccaaaatctgccggaagctgaacgtcctgtgcgctcttgcatacatcatgacagaaccaattttctgttccaggctcaccggttctttcttaatcgttccaaagctgcttctcacgggatcgatcttgtcttctttccgtttcatgacggaatcaaagattttctgcagctttgcgagcgtcagtccgtcgagaaggctgtctaaatccaccggaggctcatatttcgccacctctctggggatcgtgggttccttaaacaggtgcctcattgcatcctgctccctctcctccagctccatagccatatacttgtatgtcttatattccagcaggcggcgtaccagttccgccctcggatcctcctcgtcctcttcctctgattcctccaccggcaacagcattctggattttatatcaatcagggtggcggccatcaccaggaattcactgacaatgtccaggttctcttcctccatccggctgacatagtccaggtactgctgcgtaatcagcacaatcggaatatcatagatactgactttattcttttctattaaatgcagaagaagatcaaggggaccctcaaaattctccagcttgtaggaaattcccatttagattccttccatcctgtctccatattaaatgcggcataaaattacctcgagggatacaggccgtgaataataactaaaattaatccccggcctcctgatagtatatcaaagatggattttcaccgcaacctgatcttcaccgcgggttgtccggatatctgctgccgtaagagtccacacggccagcgcagtaaatgcgcagacctgtctgaactgttactttggttccagcgtgatatggattagctggggcctgtcgttcagtctgatattgacggaatgtgttccaagcccgcggctgacaatcattgtttttccttctttgtcaaacctgcctgcacaccagggaagaaaaaactggtactgcggggtcattaccccgcccagcagagggaggcggatggtccctccgtgaaagtgccccgacaacgtcaaatcggctccccagtggcggcagttattaaaaaacagcggcgaatgcagcagcaggatttgaaacctcgactgatccgccctgccgcaatggcgctccagctcattctccggcagaaccggaagcgtgaaacggtgtcggtaatagatttcttccatattacagccggtaatccggatatccgtaccaaaatcggcgctcttgtccgacagatagaaagcccccgcctttttaagctccccggtgaatttccggtagagaccgccgtagaccgtcctctcccttctcattctctcctcatggtttccattggcataatagaccggataacgtgatgccagttctcttacgagtgacagcgtaacacgcaaatctgcctctccccttgaaaccatcatatcgcctccgatcaggacggcatccggatgaattctgtctatttcttctatcagcagtctgttatttactccaaactcattattatgtagatcggaaagaaacacgaaatcccgcttctgtcccttaattttctttgaagaaatgcggtagtgatctgtcacgaaatgtttcttttcgtattccgagcgaaggatcagacctccggccgcagccgccagggcggcaatacatgcataaagcataacttcctcctatatttaacaggttccggccagccgcctgtaagacggtttggccggaagcatgcctgccgctgtacggcaggatatttacagtaatttcataattcaaactgttacgtttcagcagctttcacgcaggtttgcataaggcgcctgttccaggcggatgaagtatccctgttcatgttcacatacagggcagtatttgggagcaatctttccctcataaatatagccgcagttcagacatatccattccgtatcttcttccgccgcaaaaagcctgctgctttccagcagattggcaaatattccgaagcggtctccatgcgtcttctccacatccgcgatcatatggaaaacatggccgatgcggtcaaagccctcttccagggcaacgtcgccgaactctttgtacaccacatcgaattcttcgaactcattatgctctgccgccctcagaagatcaatcgtcttttcatacatatcaaccggatagcctccgtcaatatgaattgtctctcccgtcatttcttttaaaaacttatagaatacttccgcatgctccttctcctgttcggccgtgtataaaaagaccttttcaattaccggaagtccttccttctttgcaacggaagcggaaaatgtgtagcggtttcgcgcctggctctcgccggcaaaagcacgcatcagatttttagctgtagcgcttgttttcagaacactgtccatcaaattattcctcctgattcatttgttggtaatagtttctccgaaaacaggcaatgtataccaatcatcatacacttaactgcaaaaaatcgtcaagctgtcttttccccaagacgataagtcgccgtcgcctgcacggaaaaacgcataatattgacatatcccaattatggataatatgcaactaaagccgttcagtatttaatgatatgggaggtgcagataccttgattacttatgataaattatgggaaaccatgaaggaaaagcagattacacagtaccgtttaattaaatactatggctttagtgccggacagattgggcgtttaaaaaagaatatgtatgtctccacccatacaatcgaaacgctgtgcagcattcttgactgcaaggtggaagacatttttgaatataaagcagatgagacgttctgcaaacagtctcccgagccgtcctgtgatgaatcctttaaagcggttatggacagtgagcattaaatcatccttacggctcagctttctttggcaggctgttttctccatacacacaaattccggcttttttcaacaggcgcactgttatgccgtctccgggtatcagcttttttgaaaaagttccgtcatatatgaaaccactgccgcaggaagggcttctctctttaagcaccgctctccggcagtttttttcgcgtgcaatctgcagggtttcttccgctccccttacgtattcctccgtcacgtcgcggccgtcctttgtaacgactctttcatccctgatttcagcgggtgtccgcggcgtccggagtcctcccagcacttccggacagacggggatgatctccgcccccgtgattttcagatagtcaacaacactctggcagtaattggattcaccgctgtatttacatttctcacccagaaggcaggcgctgacaagaatcgtttccccgcgctcttccctctgctctctccccatatccctgcacatattggcatctcctttttaattatgaaactgcaaactggctgttataaagttcactgtaaaagcccttttgggccagaagctcctcgtggctgccctgctcgattatccggccatttttcattaccagaatcgtatctgcctcgcgtatcgtggatagacggtgggcaacgataaaactggttctgccctccatcatcctcgcaaacgcttcctgtatcataatctccgtcctcgtatcaatggacgatgtcgcttcatcgagtatcagcatgggcggcaggcagagcatgacacgggctatgcacagaagctgtttctgcccctgcgacaagttgccgccgtcttctgagataaccgtatcatagccctccggcatacgcataataaagctgtgggcatgcgccttcctggccgcctctataatttcctcctcagcggcatccggttttccgtaggcaatgttttcgcggatagatgctgatttcagccatgtctcctgtaataccataccgtatcccgcccgcaggctttctcttgtcatattgcggatatccgttccgtccacccggatcgtcccctgatccacgtcgtaaaagcgcatcaagagattaatgaccgtactctttccacagccggtcgggccgacgattgcaatcctctctcccggcttcaccgtaagatttaaatcttcaatcagtctgacttccggattataggagaagtatacatgctccatggagacattgccctccacctgtccgggagcagcggccccctcggcatccgttaccgtcggctcctcgtcaatcagttcaaaaacacgggccgccgaggcaagtgcattctgaaattcggtggcaacgcctgaaatctcgttaaacggttttgtatactggttcgcataattcaggaaagacgtcagctgcccgacggtcagtactccgcggattgctgcatatgcaccggccactccgacgctggcatatacgattccatttacaaagcgcgtagccggattggtaatcgaagaaaaaaatatggccttcaggctgcagtccgcaagcttatcgttaataatgccaaaccgcctggatgcctcctcctcatagccaaacgcctggaccaccttctcgttttccagaatctcattgaccagagatgtcatatctccccttgcctcagactgggctttaaacatataaaatgtttttttggcgataaaaccggccacaaacagggaaaccggcgtaagtaccacaacgatggcagcaattaccggattgatggaaaacataaacagcagtgtcccggctatcgtgagcagtccgctgaacaactgggtaaatcccatcaaaagcccgtccgaaaactgatccacatccgtgataacacggctgagcacttccccatactgatggctgtcaacatatttgaggggaagcttctgtattttttcaaaagcccggatcctcatatcctttaccacgcggtatgtgatatggttattaattacattcataagccactgggcaagagcggtcagcaggatggtgataatcatatgtttgaggatcacagccagccccgtgaagttaaccagtccctgtgcaagcaccagatccaccgctttaccgatcagaatagggatatagagcgtcaaagccaccgttattccggccagaagcagcgacaggagaaccatccatctgtaatgtccgatatcctgaagcacccgcttcatcgtatgcttctgcttctgtgtcttctctttgttttcttcctttaacattactggttcacctcctcgcctgaaagctgggacagacatatctccctgtataccgggcaattttcaaacaattccttatgctttccgatccccgcaagcctgccgtcgtccagaaccataattttatcggcctgttttaccgtcgtcgcacgctgggagacaataaatacggtcattccatccgtcttctccctgattgcctttctgagtcttgcatctgttgcaaaatccagggcggaagcgctgtcgtcgaggatcaggatgtccggctttctgacgatggccctggctatggtgagacgctgacgctgtcctccggaaagatttttgcctccctgcatcagacctgcgtttaaaccgccctgtttgctctccacaacatcttttgcctgggcaatctccagcgcctccataatctcctcgtccgtcgcatcctgcttaccccatttcatattatcccggatgcttcccttaaaaagtaccgcccgctgtggtacgacgccgatacggccgcgaagctccttcagtccgtattccctcacatcggtaccgttaattcggaccgcgccccccgttgtgtcgtaaaagcgcggtatcagattcacaacggtgctttttccggctccggtgcctccgataattccgattgtctcccccttcattgcccggaaatcgatgtcggtcagcgattctgcttttgcccctttataagcgaagctcacatgctcaaattccaccatgggaattggggcgcctgcctgatcggttcccgcaggattcatcgggacctccggtttctttgccctgttttccacaatactgctcttcgtctcaaaaacattattaatacggccggcacaggcaaaggcctttgtcatcgtaataatcagattggcaagcttgataagctcaacgagaatctgggacatataattcaccagggctaccagctctccctgcggtatgacgccttcgtttacctgtcctgaaccaacataaatcaggaccacgatagccagattgataattacataggtaatcggatttaaaagagcggaaatctttgccacgaatatctgaaaattaaatagcaggccgctttctttataataggctgccgtctcgtcctgctggcggttgaaggccctgaccaccctgactccggtcagattctccctggtcatctgcagtacccggtcaagctgcttctgtacctttttatacagcggcatgctgatgaacataattccaaacacaacaatggaaagtaacggtatcgttacaacaaacaccatagccgatttaaaatcaatggtaaacgccatgatcatggctccgaatacgataaacggagagcgcagaaaaaggcgcagcgtcagattcactcccgactgaacctggttcacatcgctggtcattcttgtaatcagagtagccgttccttccgtatcgatttctgtgtaagaaaaatggttgatatgatcaaaaagctcttttcgaagagccgtaccgaatcccaccgccgccttcgccgcaaagaactgggccgtcagcgaacaggccaatccgataattccaaggagaatcagaattcctcccattcttaggatataaggtaaatctccatttctgataccggtatcaataatctttgccataacgagcggtacaaagagttcaaaactcgcttccagcatcttgaacaacggcgccataaccgcctctatccggtattttttaagatatttcatcaaacttcccatggtgattcccctgtcctgtatctatgatttatcgttctcttctctctatttcatctatctttctttaaagcttcctgcaattttgcactttattttaacacaacaatgcggcggcttcaagtagttagtctgcgggtattaaggctttcccgcttcatttttggcaatccgggatacaaatttttcccttcgttgctatttttccgcccgcatggtaatattattagtaaatgattttcccgattggaatggagatgctctatgatttatttcattttacagtgcaagaaaatttatgacgagtttgtaaaggatgagatcacggtctatgcggctcaggcctcattttttattgtcctgtcattctttccctttatcatgatccttcttacagtgattcagctggttccaaccatatcccaggcagatcttcttctggtgatctccaggctgtttcctgaaaaggtatatccgcttgtggaatcgattgtaaccgatctgtacaccacggctccggctgctatcctctctgtgactacgatcgtcaccatatggtcggcctcccgggggatgatgggcatagaacgcggcctgaaccggattatcaactgtagcaagaggaggaattatgtgatcagccgcctgattaattccggctacaccgttgtctttatcctggtctgcattatgtcgcttgtactcatggtattcggcacttcgctgcagaggctcctgcttcgctatctgccgatactggaacatattgccccatatctgctcagtatccgcgccctgattgccctggccatcctgatcgtcttttttatggggctttatacctttctcccctttgaaaagctggagcttcgaaagcagctcccgggagctttgttctccacggccggctggattgtctgttcctatggcttttctatctattttaatcattttaaacggttttcctatatgtacggcagccttgccgccatcgttatcttaatgctgtggctctatttctgtatctgtatcctgttccttggagccgaggtaaaccagcatatgcatttcggcagaaagccatgataatgcctgtcccggatgcctgaccggacaatggtatgtaaaaaacggagcattgtcccttcaggggccgccgctccgttttttagtattcttgtcaggtattcttggctgccattccggctcttaacgatatttctcccgcagatattcaatataatatttgggggtgaaatcctcgcccgtcacgtccctcagaatctgcctgctgtctttcagtttcccgtactgatgaatcttttccctgagatatttcctgattgcttccagcttgccttcccgaagcagttcttccacatccatctcctgtttcatagtgtggtaaatctgtgcgccgaaggcgcttcccagggcataggacggaaagtagccaaaggagccctgggaccagtggatatcctgaagtattccctccgcgtcatttttcgggctcacgcccagatattcctcatattttttattccagatggccggaagttcgtcgatttccacgtcctcttcgatcatcattttctcaatttcatagcgtaccagcacatgaagggcataggaaagctcgtctgcctctgttctgatgagtcccggaaccgtcttattgaccgctgcaataaaggcatccaggctcacgctctttaacggagtcccgaacatatccgccaccgtatcgaaaatcggctcccaaaacgccttgttcctgcctataatgttttcaaaaaaccgggactggcactcgtgcatacccatggatgctccctgcccaaccagtgtctgggtcaggtcatcgcgtatccccagttcataaagggcatggcccgtttcgtggattaccgaaaagatagaggaatcaatgctctctccatagtgcgttgtaattctgacatcgtggttgtgcagatttgttgtaaacggatgggcgctgacagccagcacacccctgccgaaatcaagtcccacatattctgccagaaaccgggccgcttcttcctgcgcctgctcgggataatcagcggtcagaaagctgtcatccactttctttgaccgctctgccgcatcatgaagcataggaacaatattctctttcagttcgtcaaagaaacggtcgagcgtttccatatcgaaacctttttcataggaatccagcatcacattatacagcttctctccgtcttttgcgcggtaagaagcaaatttcttctggtagcctacgatgtccttaagcaccggagcaaattttttaaagttcttctcttttttcgcctctgcccatattctggtcgccttggaggtcaactcggcaaattcccggtattccctgggaggaatacactgaagcttttcaatttcttcggccgcctccctgacaatcgcctgctccgcctctgtaagcccctgctcattccggcaggcgtcaaccagctccttcacttcttccgatatcataatctccatgtactgtgcagataaggagccgattactttcgatgtaaaaggcgccgcttcctttggagccaatgtttcattatcccactcaaacagcaccattgatgcctgtatcgccattgctttttccaaatatccacttaatttttcaaatgttttactcatatcttctgtctcctctgttaaaactgattatggattcgttgttattaagattagcatattttcaataaaaagaacaggaaattaatagcagtagtaatgccaccttgttttcacatagacgccttttccctgtctgccgcccgactgccatatgacattggccggaagcacgctgccgttttcgagaagcgtcctggcatttgcccagttgcgctccgtcggctccctgtaataatttccgtcccttgtacaggaatactgtcctttctggaagacaactcccttgaccgtgtttggaaatgaaggatgattttttctgtttaaaacaacagagcccacataaagctgttcctgatccgggcagctctggcattctccggccagcacatgagccatcacgtaaagatcttcctccgtataggccgccggctgtgccgccgcttcctcttccccgctctcaacagtctgagcctctgagccgtttccgtcctgtgccgccgcttccgttcccgccgcagcctccgccgccggtccataagccatagccgcagcagcaggttccgtttctgtctgctgctccgccgtctgttccgctgcaatctgttctactgccgtctgcactgctcccgacgtttccccctccgccgcaaacaaggtcccgggcgccatgtacaacagtgtgataaccggtaatatgcataatatcttcttaatcatagtcctccttaataaattgatttcagtttctttaccaatatatgtcaattcaattaaaaatatatttattattgtacaaactggagatttaactgaggtttggaggacgcgtccggaacggaccatgtccggtgtggtgagagggctggctgagtcttccgtccccgtgggaagttggtcgcggaggggaatccggccggaatgaattgctgcggggaccgtttgcactctttggagtgcgcatcggaatgctaagctcgtgaggaacctcgccaagcaccggcggactcccatgtcccctacgcaattgattccgcctacttccccggggcagattttcgcctgggacggaagactcaggcggaggttttcgcggcaccggacccggtccgttccgggcgctgattgtctctaaccttaaatggggaggaccctgtcgcgaccactacgtgttaacgcgtgagacactcagcggccgcaggccagcggacggggccgatacacccggcggagtcttccgttccggcgaaaaccttccgggagaaggagatactgccgacatcttccggcggagaaggagagaatgatatccggctccgccctgcgaaaacaaaaccacagtatctccttctccatccagcgatgccaaacccccgggacgaaagactcataaaacaatcccaccaccccgtccgctggcctgcggcggcgtcctcacctgcttatttaaatcttgcatattatcagaaaaagcgttatacttgatgcaatataagctaacacaccaggaggaattgcaatgattgaggcaacgagctgcggcggtgtggttatttttcgaggtaaaattctggttttatataagaattacaagaacaaatatgaaggttgggttttaccaaagggaactgtagaaccgggtgaagattataaagaaacggcactccgggaggtaaaagaggagacaggtgtatcggcctccatcataaaatacatcggtaagagccagtattcgttcaatacgccacaggatatggtggaaaaagatgtgcactggtatctgatgatggctgacagctattacagtaaaccacaacgggaggaatattttatcgattccggatattacaaattttatgaagcctaccaccttctgaaattctccaatgagaagcagattctggaaaaggcatataatgaatatctggacttaaagaagagtaatttatggggcaataaaaaatatttctgaagaaaggcgggggacatcgaaactgtaacgttacgatgtcccctgccttttcagattatctgactacctgtaaaatacaagtacggtacgttttcatcaaactgacttcttcgccagttcccttatatgacgatttttcctgaaatacaggcaggttaacacacccgcggctcccagtatggcgtacagcattgctgcaccggagccctttccggttccgaacagcgctgtaaacacgctatccggtccctggaggctcataaacggctcaaagacacgatccaccagggcgcctcccagcagatatcccaccggaattgtaaaaaactgcagtgaatttcttacggaatagacccttccctgcatctccaccggtatatggatacgtagcagaacgtctaaattggcattcatcagcggtatcatcagccagccgagaacggcgccgaaacaccacaccggcatactccggccaaatgccagaaaaaagttctccgtacacatggaaaacatcagagaattgcaaatgaccctgaccctgtttttgggcgcaggcagtgcggaagcgaaaatgctgccgactagactggcaaagcctgtgaatgtgttgagggcacctagcgccgtcttaccgcctccggctctcgataaaagcatggcaggcagcgctgcttcatagacggaagcgatcaggttgacagctgacagaaagagtatcagtccgagaatccccctgttctcctgcagaaaatgcagcccctctcccgccgatttcagaaaagactcacggttctcccccttctccttctccgctttcggtatgcggataaaaaaagccagcgagagaaatgccgtcccaaagctcatgaaatcaaacaggataaccgcatccattcccgcaaaagccaggacagccgtcgctatcatcggcgtcagtatcgttacaagggagttggaaaatgccttcaatcctcctatccgctgatactgctctttcggagtcagcaggcttaccgccacctccgaagccggctgctgaaccgaattagccatgccgttgactgcgttaatcagataaagatgccatatctcaagacgcccgccttttaacagactccatacaatcagggtcattaaagccgccagcgtatcgcacaccagcatggttttcttcttgtcccaccggtcgctcaaagctccggcaaagatacttaacaggacatacggcgcataagagcagactgccagcagcgctgttgtgagcgccgagccctgcctctcgtaggaccatataataagtgcaaaatttgtcatggagctgcccagcgatgaaaatgcctgcgtaccccataatatcaaaaaggcgttaaggcctttcagagtttttttatttattctgttttgtttatttatgaaaaacatatgactttgctccttttatctttttattcagatagagtgcaaagcctgcaggacgtatttactccatgcagtccgtcccgtatcagaccttgcatggagctgtgtcaatgcatagtttcatatcagttttcctcctaaaagaatatttcgcaacagttcagacagcatgaactgttacagcatttcaaatatcagtttgactatcagcaccgcagctattacaagcatcatcggacgtatgaacctggctcccttccggattgccattccggagcctgcgtagccccctaaaacgccgcaaatggcgacgggaagcgcataattccagagtatcttccctgccagtaaataagaaatcgttcccgccagagtggagctgaaaacagctaccttggcgttgccggaagccctggtcaaatcatatttaagcagctttgtatagattattattgccagcgttccggagcccggacccagcataccgtcataggctcccatcgcaatccccgtgaaaatccagaggccgattttcctgtttcccgtcacttcgtcggagtgatcctctttcggatactttttattaaccagaatcaggatcgcaacaaaaggcatggagcccagcagcatcaggctcaaagcccggtccggcatccaaagcacaatctttgaggcaaggacggaacaacagaacgtaacggctcccacaaagaacgccgcctttttgtcaatcaggttattcttcagataccgtcctgccgacatagccgtactgatattacagcacagcttattgcaggcataggcgttatgtacgggcatgccggtaaacaggtaagccgggagggagagaaggcctccccctccggagattgcatccacaaaactggacagaaacataatcgggcacaaaaacaataatgacgttatataatccatactcatctccagtaacattgaattgttgcagcagttcagccgtgatgtattcgcgaggtgttttcgcgaaacagttcagacagcatgaactgtttcgtttttgctgctatttgcgaaaattataactattgttgtataaccggggaattactgctttgcaaaataggcgtcaaagaccgcccttgctatcggcgcggccacctttccccccgaaccggcttcctccgcaatcacactgattgctatcttcggattctcagccggtgcatatcccacaaaccaggaatgtgtctctttccccgtctcaaactcagccgagccggtctttcccgcagccgtataccggtctgttcgcagcgcggaacctgtgccaaaatccacaacgctcttcagcagctccgccatcatctgggcatcggttgcagatagaggacttccggccgacgagggcaggaacttcttgaccgtctggccgcctacgttctccacatgatcgatcaggtacggtttcattaacgtgccgccgttggcaatcgctgaaacaatcaaaagattgtgcagcggcgtaatctgcgtcttgccctgtccgatagacgtttggagtttttcccattcatcggccccgcctgtcattgtaaaagaactttgattatagggcagtgcatatggcagcggcatattaaacaggagctgctccgccaaagcgtggaaactgtcggggttcagctgaaggccaatctctgcaaatgccccgttacaggaatttgcaaatgcctggatcagattctgctgcccatgcgattcactgtgataacatttaatcgtatattccccggtgtgatacgctccgctgcagttaaaggaaaaatcctgccaggtggaagggttttcccggatatattcaagagccgttaaaattttaaatgtggagccgggagcatacagtccctgtgtcgcacggtttacaagctgcgccttcgtgttatccggcgcaatcagctcctgccacttctcatccacctggtttgcattaaaattcggctgcgaaaccatacagagaatcttccctgtatccggttccatggcaatgaccgcccccctgttatttcccaatgcgtcggaagccgtcttctgaagatccagatcaagcgtcgtcactacattgtctcccagattcttctcaccgcgaagctcattaatcaccttctccaccagattgacatgtgaagaaagaagataaaaattagccagtgattcaatcccggttttaccgttcaaaccagaataacccacggaatgaacgaacaggtagtcaaacggataatagcgggtctctgttttgtcggaagcaacccttgtttccgccagaaccgtcttgtcgctgctcagtatacttccccttataatccggtctgaaaactgatccagccgtgcattgtatgaactgccaatcacattctcactcttaaactggataaaccagccgaggtatgcggccatcatgataaacaatgcggcaaacccataggtgagctttaatatatttttattggccttcgctctgctgtcaccggaatccctgcgttttttcgtatctttcttctttccgccagggccgaagcgtttttccgtttttttctcttccagggagccatgatctttaagcttcataatcttcctcctcttcttcatttctcttcaggataaaaagtccctgaataacgccgaacaggataaacgtactcaaaatcgagctgccgccatagctgataaagggcagtgtcacaccggtggacggaatgaacttgatgacgcccccgatggtcaaaaacacctggacgatgtatacaatgccgagtccgaaagcaatcagcttgtaaaaaacggcctgcatcttcgtcgctatcagcataaactgaagaaaacatccaagacaaattaaaatgatacagagggcaaagatgcctcccagctcttccgatatggccgcaaagataaaatccttctccacaaccggaatcttcttcggcattccctgataaagccccattccaaaccatcctccggtgccgatggcaaaaagcgcctgtgtaacctggtaaccttttcctgcaatgtcgttccatggattctgccaggcctccacgcgcacccggacatgggaaaacaatttataagccactgctgccgccatgacaccgcagcctgcgcccgcccccagataaaaccagttcgaagttgcgataaaaagcatcagcagataggtaacgaaaaaaatgagagcgcttcccaaatcctttgaaattaccagcaccagcacatgagccgcggccaccaccgtcgtaattactatcgtcctgaaatcaatggagcggtaaaacatcgttgcaacaaagaaaacaaagctgattttgacaaattcagacggctggaaagaaaacccgcccacattaatggacagctgggcgccgaagctggtacttccgagaacacagaccaccagcagaagaaaaagaccgattgagccgtaaacccaaggaatcttagcaagctgccacgttctgtcgatgataaacggaatcagcatagttactactgccgccaccgcggcaattacaaactgcctgaccgccctgtcaaaggaaattctggacagcataataaaactgacacacaggagcatgcaggtgttattcagaagcagtcttgataaattgcggtaaaacatcctgtagaagacctgataaagcaggaaaaacagaaactgggctccgaaaaacatcagcatcttctcttcctctgtcctcaaatagatcaccgcataagccagcacatggataaaaagcatggcagcattctgaagcctgcacaccctgtttctggaatgctcatccggcatagcaaaaaatcggaaattatagtatgtgtaaattgctatcagcagtatcatcagatactttgataatgttgtaacaagattaatcacactctcacctactcgatccctcgtttaaaatggcctctcgtgaactcacccgggagttccgtttctctgccctccagaaagctgccagaaaaggctctgattaccgccctggtttcttcccggttctccgtcgtaaaattaagcctcaggctctccgggcccagcccgtcaatcctgtgcctgtcctttaaaagtgacagcgggcttgtattataaatcgtattatagcagaaacggcaatgattctttaccggaaattccttgcccatcctgtcccgcaggaataacagctccggctttttcttacaggaatccaccgtctttttcatgcactgggccgtcaccatcatgggaaggcggccgtaaacaatcaattccccgccccggcatcccatgtcttcaagttctctgctgttaagctctaccggaagcgtcaggcggtgccggaaaccggaaaccatctttgccgtcatcttctcagcggctctgttcatcgtatatattccataatccatgatcagagtcaggtctttcagctgcgaatattccccggcccactcctttaaaagcccaatctcttcccaggcccggattacggctccgtcaaaaccggcgtttgccagaagctctttgttcgcatcaaaataacggaaagcctcttccctgaaaatgtgcggcagcaccaggaaacaccgtttcccagcatgatggcagcggtttgccagctcattccataaaaccgcgtcaaaatgagcgctgtccagataaatgccgtccacgctgccctcctccagaaccgtctcaaactgttcaggctcttcaacggatacgttcaggctgtaaagtccttttccgaggccgtccttatcctctgctccggattcagacatgtccggggcagttttacattccgaagctccggattccctctccgggagcagctcctttatcttccgtctgaaggatgactgtattccttcctccaaagcggcaaatccccgccttctcagctcattcagctcctggacaggaacaaagggattaccttccatctctacattaagctccctgaaataaaacggagtatttccggtcttcccaatctgcttagcgatttttccctcggttacaggctggttctttgcctgctgtgcctcttcacctgctaccgtaacttcgaccgtctcaggcatctgtccatccctcatgtttctctcgaaacggagtgtcagtgagagcggttccccctcttttacagcaaccgtgccgctgaccggctccttcagttctgcctccacatacgtctcgtcaaggtactgatacagttctctgttttcctggcggaatgacggtttttccttcataaccaccatatcgcgtccgttatgctgccggtagtacccctccgtctgtccgccccggtcgaaaagatccaacagcctctgccggtcttccttctcgacgcggtagcctttcctccccttttccaggtacagatccacatactttctgtatatgctgaccacccctgccgtatagcgcggactcttcatccggccctcgattttcatcgaatagatacctgcctccaccagttccggcagaatatcgagagtacagagatccttcaggctgagaacataccgttcctctttattatttaacgtttttccatcccttttcacttcaaacggaagacggcaggtctgcgcgcatctgcccctgttgccgcttcttcctccgatcaggctgctgaacaggcactggccggaataacagtagcaaagggctccgtggacaaagctttctatctctgctccggtctgctcatatatctttcggatctcctgcagagacagctctctcgccgtaacgatacgggatgcccccagctccatcatcagtccggctccctgagggccggttatcgtcatctgggtactggcatgcaccggtaaatccggaaacttctcctttatataggaaaacactcccatatcctgaacaatcgccgcatccagcccctgcctgtagtacggttccagatattcataaagtccttccagttctttttccttaaccagtgtattgacagtcagatagagtctgcatccatgcagatgcgcataatcaatagcctcaagcagcatatcttcaccgggattatcggcataggccctggcgccaaatcggctcccgccgatataaacggcatccgcaccggctgccaccgctgctttcatactttcaaaagaaccggccggagccagaatttccaccttgtttttcataatatccaactccattttctaaaaaagacgacaggctgatgtattacgaatcctgttaaagaatttcgtttccatcagcctctttcatctgtaaatgtacgcgctgctttccggccttacttcctggcctgctcctctttttccgcttctttaccgcgggaatgttccagagtttccagcgctttatacttttccagctccgctctcatcgcttccagcttcatctgggtgcttaccagttcatgtttcaggcggtatgtctccttctccagttcttccttctgaaccgccagaagtccggcatgctctctctccttgaaataatcatcggcaatattcaagtatgtcataacattctgataatcctccggctgctttctgaagccgtcctgtctatgcagtccggcaatcttgtcattcagatagctggctacctgctgaaggtacgtctcttcctccaggccgccaagcgtatatatttttccggcaattaaaacgtctgtataattcttggaacccatcttttctccatcttctctttcattcgtaatattcatttactttttatcccaggcccagatgatgatacgcggcttccgtagccacccttcccctcggtgtccggttgataaaaccgttcatcagaagatacggctcatagacatcctccagcgttccggaatcctctcccagcgccgcggccaatgtatcgaggcctacagggcctcccgaaaatttctcaatcataatcgtcagaatagcccgatcgttattgtccagtcccagcttatccacatcgagtatatccagggcaaaatcggcaacctcttttgtaatcacaccttcgtacttaacctgggcaaaatcccgcacccgtttcaacagacggttggcaagtctcggcgtccctctggagcgccttgcaatctcatatgcgcccctctcatctatctccaccttcatgactccggcagagcggagaataatcgtctttaattcctccggcatatagaaatccatcttctgaatgataccgaatctgtcccggagaggtgccgtaagaaggcccgcccgcgtcgttgctcccaccagggtgaactttggaagctcaagccggatggaacgcgccgtggaatcctttcccagcatgatgtcaatcgcgtaatcttccatcgccggataaagcacctcttccacctggcggttcagccggtggatttcgtccacaaacaggacatcaccttcctgaagcccgttcagaatcgccgcaatctcccccggtttttcaatcgccggtcctgaggtcaccttcatctttacgcccatctcattcgcaataatgccgcagagtgtcgtcttgccgagtcccggagggccgtaaaacaagacatggtcaagagcctctcccctcgatttggctgcgtcaataaaaaccttcagcgtagactttatcttctcctggcctatgtattcatctaaatactggggccgcaggctgctttctatgcgcttgtcctcttctgtaatctcagttgttataattctcctgctcatattgcacttcctgctctcccaatcttataaaaatgccagatacttcagtgatgccctgagtactgcctccgcatccatatcctctgttatctgcacattcttcaccgccttcgatgcctccaggtttgaataacccagagccaccagtgccgtggctgcttccctgcctgcctcctgcatgaggggcacggaagttctttcatccgtatctgcgacggaagcaagcatttcttccgcactgactttatctttcaaatccaggataattctctgggccgtcttggcgccgactcccggggcctttgaaattgccttcgcatcgcccgtcagaattgccaaacgcaaatcatccggactcagagccgacaggattcctaacgctcccttaggcccgattccgttcactcctatcagtcgcctgaacatgtccaaatcctggcggttcaaaaaaccataaaggctgagatcatcctcccggacctgaaggtatgtatatatcttcacctcttctcccagaggcggcagcacctccagaacggacagcggtacgtagattcccagtcctaccggacctgcttccactacaatcctgtctcccgacttttccgccaaagcacctttaacatatgaaatcacggttttctccttatgcatacttcacttacgcccctgctgcagaggccgtccggcatctctgcgccggtttgctgccggttccgagatgtttttaccagaacctgctatccacaatatcataccataccagtttaagcaatgcaaggtgtgtcgaacaaatattctggtttaaatggagatttaactgagattgggaggacgcgtccggaacggaccatgtccggtgtggtgagggggatggctgagtcttccgtccccgtgggaagttggttgtggagggggaatccggccggaatgaattgctgcggggaccgtttgcactctttggagtgcgcagcagtgctaagctcgtgagggacctcgccaagcaccggcggactcccatgtcccctccgcaattgattccgcctacttccccggggcagatttttgccagggacggaagactcaagcggaagttttcgcggcaccggacatggtccgttccggacgctgattgtctctaaccttaaatggggaggaccctgtcgagaccactacgtgtttctgcaggcagataccaaatctagcgccttttataaaggcgcaatgaaggcatatcgtatttcccgtacacggtagcactgagtggccgcgacaaggtccgcccccgcacttaacgcgtgagacaatcagcggccgcaggccggcggacggggccgatacacttggcggagtctttcgttccggcgaaaatctggccttggggcggaggggaagataaagtctgcggatgccgttgaaatccatcgctgattagcgaggtcccttacgagcttagcagcgcgatgcatttcacagagcgggagcgtgctccgcagactttatcttcgcccgtagtcccaactcacaacaatcttccccgggacgaaagactcatatacacaccccaccaccccgtccgctggccgtaccggcggcgtcctcacctgcttaactaaatctttacttcctaagcgtttccgaatataatactaaccatagatcccacatgtcacctgctattttaccaaagggagtttatcagaatgattacaatcgaaaaaaaagtagatttgccggttacatatccgcttgaaaccatcgggaaattgaatgaactgttgttttttgatatcgagaccaccggtttttccggcgattattccacgctgtacctaatcggatgcacctactaccgggatgggagctggcatctgattcagtggtttgccgataccctgaatgcggaggaggagcttctccacgcattttttgccttcatggaacactaccgctatctgatccattttaacggtgacggctttgatattccctacctgttaaaacgctgccgggcctatgatttggattacgggtttctcaatataaaaagcgttgatatctacaaaattatcaagccgtacaagaaactgctgggactcgaaaacctgaaacagaaaaatatcgagtgttttttgggcgtatgccgtgaggataagtataacggcggccagttgatcgaggtttataaagactatctggcaacccgcgacgaatttctgtacaatctgctgatactgcataatgaagatgatctgaaaggaatgccgtctatcctgcccgtactctattaccatgatttcctaaggggaggatttgcttacaccggccaccagctctgtaatatcagcgatgcgttcggttctgtggaacaagaattgaagctctgttataagagtccggttccccttcctgtgcctgttcaatgggagctgcctccgtttgcactggaactgtccgaccggcttctgaccgtttccgtcccgctttatcagggagaattgaaacatttttatcctgattaccagaactatgtatatctggtttacgaagataatgcaatacataaaagtgtcggtcagtatgtagaaaaggatgcaaagaaaaaagccactgcaaagacttgttatacgagagtttccggaatcttccttcctcagccctgtgaaatctgggacggctgtgtgaaatccgactataaggccaaaacctcctatgtcatgttccggccggaattattggaagaagagggggctgccgcccggtatctggacggggtgctgaaacatattttgaattaatccggtgaaataaaatacaaacgggacctgcataactaaacagagacagggccggaatcagttttttgaattccggccctgtcttattgacggcggtgacctgtgcgcggagcgaacaggttatcgttgacggcgcgacctgtgccttagcagcttcctgatgtaggcaaacgtcttttcctctccctcatccttcagcattaacagcagcttttcaagctgcgctctcgtttttttatgcatcaccgcataatcctggcctctggcataatattcccaggggcaggcatccgtatatgcatcacctttataaactttcgaggcggcaatccggtccattaccatttccaccaggtatttgagaggcatttcgttaccaatcagacctgccgatttgtcgggggcaaagtcgatccagtattcaaaatggtgcttattccggcctttatgatggagccaggcaacagaatagcccttttcttccttctccgcagcgttgggactccgatctccctgatagtactttaccccaatcctgaattcctcccaggaatatttcgacaagtcatggagaagtccctgtttatatagtcccactttaaaacaattttccattaccatctgtttatgttttgttatggtcctgaaatggcggaccgcattccaaagcttcattctgctctccttacaaacccggcaacgcattgctcccgtccggatcctactgatacttattttacatcagtcatttgcttttatcaaccatgtttcttctgtccgtttctgccgctttagcgccatttttctcctgaatcggccctttttcttcccgcttttcttatacgtccgccagttaaatataaaatgattgcattaactgttactgttcacacggctgtgttccgcgaggtgttttcgtgcgtattctgcacgaaaatcccgagttacacggcgcgaaactgcgttttgctgtttctgtgcatcgcgagacgtgtaactgttcgcaccacgctgctttttggcggggtgtgaacagttacaattttccctgtaattcccataatttcccgcaaaaatgtttgacagtattctaaaactgtgctattctgagaacaagctgtagatagttacagtaaaacatttttttatttttttggaggtatcatatgaataaaggtacagtaaagtggtttaacaaccagaagggctacggattcatttctgacgagcagggaaacgatgtttttgtacactactcaggcctgaacatggatggtttcaagtctcttgaggaaggcgctcaggtagaatttgaagttgttaacggtgcaaaaggcccacaggcaacaaatgtagtaaagctttaatcatcaactttccagtgtacctctttccataatatgttaaatatatattttgtgaataagttatcattgaaataagtaaagtgattacaattaagagtcatccattcggatggctctttttgttggagacggtgacctgtgcgcggactgcgccggatattattgtcacgctgttatatttcaaatgtttttgcccgtgtaacagttcagacagcatgaactgttacacgggcgtttctcatcttacggccttttctaacaatcccttcagttcgtctaccgtaaacgcataattcttattacagaaatggcagttcacctctattgtcttcccatcgtcaatcatatcctgtatttccttcttcccgatgctgatgagcgccttctccaccctctccttgccgcagttgcagtaaaaccgggccggcatttcctccaggatttccaggccgaattcaccgatgatggagtccagaatcatttcaggggtcattgcggaatccaggagggaggttaccggctccatctcccccagctttttctccagcttgtctatgatttcatccgacgcccccgggagaagctggataatgaagcctcccgcctgacgcaccgtattgtctttattcattaggacgccaagggcaactgaggaaggagtctgctccgaggttgcatagtaataggtaaggtcctcagcgatttcacctgaaacaagaatcgtctgtcccacataaggctctttcatcccgatatccttaatcacgcttaaaactccgactcccaatgcgcctcccacatccagctttcctttggcgttcggcggtagcatgacggacggattaaacgcatagccttttacgtttcccgcgctgtcggctgtgacggtaagcccttcaatcggaccgtccccttctatcctcagagtcagaagatccttctcgcccttcatcatcactcccatcatggcccctgccgtcagaagccgtcccaacgcggccgtcgctaccgggcttgtattatgggcgcttcttgcctgttccacgagcccccttgtcgtcgcagcaaatgcgcggatctgtccgtcggccgcagtggctctgattatataatctctgtctttaatcatgttctgctttttcctttctgtctatctgtaggttattcgattcctttatttaccatgctctcttacaatgatataaatacgttcactcgtctcaccgggagcttctctcgtaaacgcgtcgtaggcggcgacaaattccatacctgcctctttggccgcggccgccgcttcatccagtgtataagccctttggaaatgggtttcacggtactttctgtataagtccccgtcttcttttataaacagggtcagatcgtactcattaatgcgctctgtctcatcgtaatcgttatcccagataaaactgctctcctccctgtcctccgctatcgtggactgggccaggatttccctgtatttgtactccgtattcagatcaaatataaaaatgccgccgggatccagatagttatttacaagggagaaaacctgtaccagttccccgtaatccagtatatagttcatcgaatcacagatactcacgactgcccggacagtcccgtacagctcaaactcccgcatatcctgcagaagatacagaatcggaagtcccgactcttccctcttctccattgcgatctgaagcatatcctctgaaaaatccactccgatcatatcgtaaccctcctgtgccagaagttctgtaagacttccggtgccgcagccgagatccaggagaatgccgtcctccaccccatattctttaaggagcgatgtgagataggcacaccactcgccatagggaatattatccataaacatatcgtaaactgatgcgaagctggtatatgcatccatattaatcatcaccttttcataccataatttaaaccgtaacattcaatatatcaatttttttctataaaagcaacctgttcttgattatttcacctgctttgcgttatacttatgtaacaccgttccaattttccctttgaaagtgattaaacagatgaaaaacagttttattgttaaaaatatacggaaagcgctgctccggcagttggtttttccaatccttctctttattgcagcaatggccgcgctgataaagattccaagaacaaattttctttttccgcggcctctaaattccaaaagccattatgaaaatttttataaccgcgatctcccctacgtcagcgtcacggcatcggatttacattatacaggatgtaattacgttgtcaacggacggaccgagggctattactattataccctcgacggcggattttgtcagttctatcttctggatggcagtgatctctcagattcccgggatggaaccgtttcttcccttaccctgaaaggccggctgatagagatgaaggagagcgaatatacctcccttctcatcgagatggcggacgatcttaactggaccgtatcctcactgaaagaaataacagccccctatgccgtctccacactgccttatcctgtatacctgaccgtcttattccacctgctggcctacggctgcattttcctgtcactgtcggatatcatctgctcgctgtattatatctgggagcctcaccgttctccgacgttccgttatctgggcacctttggggaggtacgcaccctgcttcccaaagtggaaattgagatgaaacacgtcagtattgcgaaagcgggaaatatctatctcacccccagctacatcgtgaacgtggacactgtcagaagcctgattctgcctcttgaatcagtcgtctgggtttattatcacagcaggatgctcccgctgcccggttttgcccgcttccacttccggatcagctatacgctccatatcgtggccgacgacggcaggacttacgattttaccggcaaaaataaagaagatctggattatatcatttcttcgctggaaaagcgggataccggtatactgctcggatactcggacgtgaaccggcggctcgccaaggaaatattaaaaaagaacaatcgctgaggtcatgagacttcagcgattgttttgtataatgaaatatgcgactatctgataacaccagcggtaatgattccctcgccagctttgcggtggcctgcgcagagtctgctgaatatgatttaatcctcctggctccccgccagaagaaacagctcattgaccgccacagccaaaggaccgatatattcaattctgtcgctaagctttgacttcacaatatatccgccgtgataagatgcatcataatgactgcaaaaatgcaggaaacgctcttccacccgcggatggctgaacatctcgccatagataatgaccttgtcgggagccagcagggttatggtattcaccgccacccttgccaactgttcaatgatatcgtccagcaccctgccgagtccttcatcctccgtctcaatccattccgatatgttcctggcctcaatcctgtttggatcgccttccatcagccggcagagctgcggcatcgtctcctccgtacatgcggcccggacctgttcggcaatcgcgtgggtcgccacctttgtctccagacatcctttacggccgcagcggcattgtttcccgtctttttccacgatgtaatggcctatctccgccgttttggaattctgactgtcatagagcctcccctgaatgatgatggccgaaccgactccgggcccccatttgatgaacagcagattttcccattccttgccgtttccatagattaattcgccttccgcaaaggcttttacattattctccacaatgacgggcaaatccatctgctttccaatcaactcgcctaccgcaaccgctttgttccaaatccggtacgcatgctggctgatacctgtcctgcggcttaccggccccggaactgatacgccgattcccagaaccatatcctttgtaatgccttgctcccacatcagagcctttccctcatccgccaccgtcttcaaaaatttctccggatcctgccccccatcggtcggcatccattttgctcccagacacaagcccttcaggttactgattgcaatacaggtttttgccgcttcgatactgacggacagcacatagcggtactgatagttaatatcaatcagaactttccttctgccggccctccgctcctcttccacttcgcctttttcacagagaatcccggccgaaataagctccgtgcagatcaatgtcacggttgccggagtcagccccagttcaatggcgatatccttcctggacatagcgccgcaatcattgaggagctttagtatggagcttcggttgctcattttcacatttcctaaattgattcctgtatatcccaaagtctcatcctgtccttcttcaataataaaacatcagcgttcatgccttcgatgcgcagacctgtctgtactgtcacaaaaactgttaccgttaacagtaaccaaaactctcttttatcagtataggtgcaattgttttttttcgcaagtaccgttttcctctgtttagccggtttccggcataaccgtgtgaacaataaccgtaaccggactggagtctgtcttaaaattgctttctgtcagctgtgcgtcacactttgtgggagatttggcccgaatgagggaggcgtagtgggctacgctgactgaattcgggccaaatctcccgcgaagtggggcgtgcagctggcaggaatgaattttaagacaggctctaataccggcagatttctgcgcccgtcatatttgccagcttttcaagctccggtgccacatcgccgtaaatcacaacaaaatgaggctcccagcccgccttcacgctgctgtggacaacttcctttgcgtccatctctgtctttacgacaattgaagtaccgttaaactgctttggtttgtcaagcgcttctccccttgcaataaagaagcggaacgttccgtccggttttcttcccacacggaatacggtcacatgttcacaggctgcacagccaaagtccatggtcgggccaattttgcggtttggatgcacgcctacctgcgctcccgtatccttccgggccagggagcatgccgccatgccgcagtgccagtatgtaatggtgccctccctctcatccatcgagacgggatctccgaaaaatacggcctttcccgtcaggctgctgccgatatacatggacagagcgccgtagacgtctgattcacagctcgacggaatgcctgatgcattgagtaaagacagtacggagcagaccggtgtgccgaaagaggtaaagaagtcgggccagcaccgggaagaaagcgcgccgataccgttctccctcacataatccctgtatgctttatacagacgggcaaagtccttcacattcttatcaggtgtattctctattccggccatccatttcttcgcctcttccaaatcagcttcgcactcttcgtcggtaaagcctttggccttttcgattaattcccttgcctcgacagcctccagagtcacgccgaaatttttaagcagctcggcgtccagggcgcgtccgaagccaaagccctgcggggtgtggccaatcgccgccatcttcagtgtcttcagccgggcctttaccctggcggcacggacagcggcgccaatcccggccgccgcttcttcctcctgcggggaaccaaaaacatattcaaattcaccgtcccggaacgtccggatggcattcgccgcagaataagcgccggtgagggaattcaggcgcagcctgcccccgtctatgacaggctcccttaaggtccagagaaccaccggacaggtaaaccgcttcagcacttcgcaggcataagccgcattggcaaatgtaatattttggagtacaatcaaatccggatggattccatccagaaactcattcagatcatcgagagtcagaagcatcttatccggatacactccgtcctctgtcagggattttaataattgtatcgacttttcaaattcattctgggcgctttccagatggaaagtgcctacaccgatgggaatatatgctacttgaaagctcataattttgtctcctttattcgtgaaacggcctttgtatccgtttccgcgcttcattttccgcaatctggccagagggccgtccgtaatgctcaggcttcagcccggctctcctcctggccttttttcattgcttccatctgttcctggttaagcgcctccaccttcttattaatccggatcatagagataacaagaactaccgtcagaatcaggatgcagcaggatatcggacgcttgaagaagatcagataatccttatcgtaactcatcatgcttgttacaaagttcatctccataatatcggccagaatcattcccagcatcagcggtgtggaggatatatcgagcagggtcagcagatagctgaataccagaatcgccgccgtcagaaccagttctttcgtattgcccgtagccgcgaacgcaccggcaaagcagaagatgataataatcggcgccagataggtatacctgacctggataatcttcgcaacggcccgtgtaagggccaggccgatcgggtacaggaatatattggcgataagacagcccaggattatagaatacgcaatcacgccctgttttgtaaacatgttgggaccgggctggataccatgcaggataaatgctcccagaagcagagccgtaacgccgtcccccggaatacccagggttaaaagaggaatcatggccgaacctaccactgcgttgttgctggcctctgccgccgcaattccctccaggctgccttttccaaagtcctgcggacgcttggaagctctccggcattcattgtagcacatgaactgggcaactccgccgcctacgccaggcatggctcccaatatggatgcaatggcagaggaacgggtgcaggccggaataatcgatttggcttccctgagcgtcagcccctctgtgtcaattttcgtaacatcgtccagctttcctgccgccagcacgaaatcccggagcttctggaccacctgggttaacgcgatcagggcaatcatggcaggcagcatatcaattccgtagcgcagagaatcaatgccaaacgtaaaacgcatgacaccggtaactgcatccgccccgatggctgccatcaggatgccgagaaggcctgacataattcccttcgggaggctgtcgccgcttactcccgctatcagggagattcccagaatcgccatggaaaagtattctaccgaagcaaatttggaaacaagttttgtaataaaggaagcacagaccagaagaagcagggcggaaaaaagaccgccgaaggtcgatgcaaacagggaagtatccagggcttttttcaccttcccctttttcgccagcgggtatccgtcaaaggtggtggcaatagccgagttcgtaccaggcgtgttcagtgtgatggcgctgatagagccgccgtacatacctccgacatagacagccagaagagagattatggctgtgtcgggcgatgaaaacgaatacgtcagcggcagaagcaggatgatacccagagtgacggaaaggccggggatgcatcccacaatcatccccaatatcagtccgccgaagataatagccagatttcccagagtaaacacattttgcagagcaagcacaatctgttgtaaatctcccataaactcagccccccagtcccggaatacccggcagcgatacgtggaacacgtacttgaacaggaaaaagatccccactcccgcggccactgtaaacagatagataaaaggtttgcgctccccgcagtaaaacagaataatcgggaaaataataactacagccggaataaatccgatattgatagtcagcgctacataggcacagagaagcaggataaaaacgatacaaggcttctccttcttccagtcaaattcaaaaattttctcttttttaaatacaaggctctggattatcagcgccgcggaacaaaccagcgtacccgccaggcaggtaccaggaatgattctcggactgggcgcgccggagtcgaacatgggaaggcggacctgcccgggcattgcaatcagcatggcaatactgaaaaggcccattatgattccggaccagagatttgtttttatcttaaacttcattcccaaacacttcctttctctgaaattatctgccatttaccggccatcgcggttcccccgcacgctccgcggaggctttcgcccgcgggattctttctcactgcctgtttaccggaattactgctgtccgctcaaagtctcaaatgcggtgagcgccttttcgcaggcttcttccaggaaggcattggcatcttcgccgtaaacctcataccgattcagcatgatttcgccaatccagtcgctgtattccggatctgcccagacatccttggaaatttggataatttcatcaatccatgcctgatccgcgccggaccgtactgcgatgaatccgccggccggaagaatcgagccactgtagtctttgccggcatccagagccggatcctttgcctcgcctgctacggatggaaccgtaatcggaccgtccggacctgtaaaaccttcaaatgccttatcggagaatgccagtaccggtatcatcgtgcctgcttccacatcttcctggcccgcctgagtcgtacctacaaatacatcaacctctccgtccgtcaggccttttttctgggctgccccgccgtcgtaaggaactaccatggtcttgccgccctcctgggcaatcagggaaccgagcgccagatgcgggtcggacagcggatttcctcccgacattttaagaccgcctgttttggctttctcaaggagatccgccagctttgcatctggttttgcatacattatccaggttctgtcatccacatccgccaccggataaatatcttttctgtcaaaatccacaacctccgtctggtatttcacgccgagatcatgcctgtaagccactccaaagccgtataccagaagatcttttgtggaaggatcctgatctgtataccagttggctgcggagaatccgtctccgccggtcatattttcaacaataaaattatattccggatggacctttcccgccaccagcgcatactttcttgcaattgcgtctgccgttccgcctacgccgtaaggacagataatcttaaccgtctgtccgctgccgcctgacggctgctgcccctcttctgccggagcctttgcctcaccggatgccgcagccggctctgccttctgtgtctgtccgccgcagcctgccagggatgccgccattgccgctgccatcactaatgccctaattcttttcttcataaaataaaccctcctgataaatttaatcttgttgactgaactgtaacgaactgtcactgttatatacagctataattacagcccgatattttctctgagccataaattcttacttaactaacagagagattcccgatataaacaataatacgtatgttataatcataaacagcctctggctcatcctggcgtacagctttcctccaataaacataccggcgagcagaaacggaactgaaataagctgtattctgcaaagctccggggtccataatccggcccggatgtcatccgccagaatcatgccgtttaaaaaaatccagaccgtggatattgtcgcccgaaagcttaccttatcctgtattttttttgtcagatagctgatcagaagcgggccgcccgatacgaaaatcccgtgtacgatacctgccagaatcagtatcagatagagggccggcgattcctgccgggacggagtctgaatcgcttctttccggctgttttgcccctctttccgaatggaaagtccaccgcgcactgccaggaaaataacaaatatgcccagaaaccggtatagcgcctgttcttttccgataaacagccctctgagcagaatacccccgatgattccggccgccatgactgccacaatttttctcagttccttccagcacacactcttgtaattcccggtaaagacataaattccggacagaagccccaaaacgttcagaaccggtttcgccaccggataccccaccagcatcagaccgggcggcattgcaagaatcgttcctgcaaagcctgtaatcccctgaataatattggtcagaagtataaccaaaaggaacagtatgtaattcatcattgtcatttacttcccgtgttttctgcggatgtccgcaaataaaggagcatactgcgaatccttcttatagaagacaggtgtgtcacctaatccggccggcaccgtatgggagcctttttcgtattcctcaccggtccacagatgtatccaagagccctccggaagatatacctcccactgtatctgtcctgccagatagacgggagctaccagcatatccggtcccagcatgtattcataccggatatcgtaactcttctcatcattttcataatgtaagaacagcgggcgctgtacgggaatacctctctctgcattttcggcaacgagttttttcatgtacggggccagcatcgtatagacatcaaccatccgtgcaagtctctccatacaatccgtatcgtcataatactggaaattttcatccggccggttcccctcatgggtacgcatcaccggcgtaaaggccgccatctccgcccaccgcaggaacagttctttcgttctggtattgccgaacagagaagtatatcctccgatatcgctgtgactcagcccgcagccgctcatccctgcgcttaaggcagcacagatgactgtcgccagcccgtcatggatgctgaaatccaccgactgatctcccgcccagagtagcgtgcagtatttctggcttcctgctccaccggcccgcatgaaatacagtacatctcccagcctgcccgtctccttcagcgcgtcataattgcatttcgcccagagaacgggccagcggttgtgttctttcatcggagattccccgttatacagtaccaggtcatcggttggcagatattcgccgaagtcggccatccagccgtcgattccgatatccaggctgtgttttttcaccacctcgtccttgaaccattcataggcggcaggatttgtgaagtccacgaccccacagtaaaattctccaaaatccaccagataatcactgccgtctgcctttgtagcaaatacgcctttttctttcccccggcggtacagctcgccgtcattgacaagataaggattaatatagcctaaaaatttaattcccctctcatgaagcttttctatgcgctttggcagttccggatacatttcccggtggtactgccagtcccactgaaggcgctttccgaaggaggtcacgcgcttcccgcaccagtcctggcaccagagtccggataccttgattccatgggagattgtcttctccagcaggctgaaggaacgctcgtcacctccctgaacccctatgattaaaccgttgtaaacccactccggaagctccggctggcggccgaagaatgcactttccttttctaaaagtccgataaaatcaggtgccgcctcaattctgaccgacgccggcacttcccatacctgcaattcatgaaaatcggggtttcggaaatcaaaatcggcataggcggtggaatttacatgtaagtaataatgctttgtggatacaaaggtcggctgcgggtaattcgtattgtaatagtctccgcccgctttgttctccacatcagatctccatgtcacataagttgtcttatccctccccactcccggctcggaagtccatagcggaaaatgcctcccccgcagattaaaataagacatctgttccccgcagccgtaacatttttcgttgtcgtctgcgtttacccgaagccagaaacggttgatatccggatttttcggttcaaagaaaagttcggcgcagtctcctgaaagctttaaagtcagaataatctcatcttccagattgagaatcagcccttcctgcgtctccctggcatccgttacagaaagcgggcgccgcgtggttacataatcctctatcttataattgccgcggtacatatccacatcttcttttccccggccggcgtaaatcatcggccgatctttactgtattccaggattgtttccccgccgtatttcaatatgaattcattaccattacgaatcagtttcatagtaatctcctgtcatcactgcccttcgtttccctctgtcaataatgcaattccttgttctcaccgattaacccggcatgagctccctgccggatcagaggttcccgcccgggatgggcaattacccatttattcttctgaagcagcagcactccctctgcctccaccgcctcatccctgtgttccagaggcgtattcgtccctttgggaagaatgacaatatccctgaatccttcgtcagtcacacggcagggggataaatgcagcgtggtctggtacatctcaaccgccgttcccttttccacgaaaaacaccttagcgtcctccacccggtagctgttatccttaatttcccataaatgccccagtaccagcataaaatcggttacggcaatattaatttcgctccctttgtggtattcaaacccattatatgtattgtttcgtccgttgcagtagccagcctgtatctccatctcgccgtaaaaaccattttgtatggaccgtatcaccggatctgcctccatttccggcacagacgcataataaatatttccgttctccggaatctgtgtcttctcctccatataggaaatcagcccagagaaatcataaccggttaccacgcgcccgtatgaggcaaactccgggtctgtcacagagagaaccggtatgtcattcacctggttcagccgttccagtatcgtcatgcttatccgcctttctattttcctgctgtttatatcagccttttaccaccttaatcgttgcgcagaaatcttcttttccgtatcccagctccagagccttgtcatatacgttacaggcattctgctcaccgggcatatcaagtccgcactctttagccagttccatgcaaatatgtacatcctttgccatattttccacggaaaacgcagtggtgtaatcttctttttcaatcggcgcagccttgccgtccagataaaagttctggcctccgccataggaaatcgcttctgcatatgcgcttacgctgatcccgtttctctgggccagggtgattgtctcattgacgccgttctgaatctgggaaaccagggcattgtggcagattttcatgacaagtcccttgccgttatcacccatgcgcacaacattctctcccatgtaaagtaaaaccccgcgcattttctcaaaagtctgctcgtcgcctcccacatagatacccagctttccggcaatagcggccggttttgattttacaaccggagcgtcgatgaagccggctcccgtctttttcaccatttcagctatctctatggatgcgctcggatcaatggtactcatatctatacaggtctttgtctcatccagcgcatccagaatttctgaatacactgcccgggaatgctccgacttcggaaccatggagataatcacgtccgatttctcagcaagctctacggaggtttcacatgccacagctccctttgaaaccagaagctccaccttctcttttacaaaatcaaatacatatacggtatcatcatgtttctttacaatattttcactcatggactctcccataataccgagtccgataaatcctattttcatgttatctcctttctgcatccgttgcgggactgccgtaacatttcagacagcataaactgttacggattgtccaacttcttaccccctgctttttatgccccgggtttattccgtgattgtgttatcccaggcattgataaaggttccaaggccctgcgtcgtgtaagcatgtttcatcgtatccttgtaaacgtcaagcccggtggtaacaatatcggctcccgccacagcacagtcaacaatctgtttcggtgtgcggacagcggcacagataatctccgtctttttatagaaaccgtagtttttatatatctctacaatgttctttatgtattccctgcagtcttctccattggcctctttccatccgatgaacggggatacgaagagggaaccgtttttcgccggaagtatggcctgtgccggtgagaaaacaagcgtcacgttcgtacggattcccatcttctccagtcttctggctgccgtgattcctgattcaacggccggaatcttgataacaaagttggggctgatcgcagatacctcctttgccatctccaccatctcatctgcatcatccagatgtgggttgatttcaactgagacagggaatttatcgattccttccagacccactgatttaatccactctgcaatgtcggttatcgccttcataaacggttttccgctgagcattatatgtcttgggttcgtggtcactccatcaattccaaatgtgttataagcatactgaatttcatcaagtttcgcgctgtctaaaaaatacttcatttttaatcctctctttcatctggccactttgattaatttaattaattatttaatatatcgaggagggattacggattattttaataagctttatcctatattcctctgttatgaaaatataatatgtctattttgcacaattgtcaacatgtttatttcatgttttttgtttttagttactttgtttaatttatttaattaattttatgcaatcttacgatttcatctttcttccaaatttattataatgttttgatatgagagtctccggttcttcaaaaatccggtttccgcccggaacagggcagaagatgatatatcggtgagcaaagcgcattggacaggttaccgtcttaacgataacctgtacgctctgcgcacaggtcaccgccttcaataaaacagggagccgtaaacaccttgcggtatcttcagctccctgtcatattattcggtttcgtccggctctttcaatgcatcagccggtttatgtgaaatctgattatttattgcgtccgcagcacttcttatacttcttgccgctcccacatggacacggatcgtttggataaatcttctgctcattgcggaccgttccggaagctttctgtgctttgtaaagctcttttctcttctcctgcgtcagaattgaatcccactgaggaagttcaaaaagccattctgccttagcctcaaccatattataatataatttctccggatcgatttcaatcttgacagacgtatcctcatccatcgtctcaatcgggttctcgtatcccttgaggctctcgttgatgccatccaggaatcctgtcatgattaatacttctgtttcatatttctcggccagttcttttaccgtaccttctatcacttctgcaggattggaaagaattttttcatagatccccttctcaatagcaaaatatccggaccagagttcttccttctgtttatcattcatcccatcgccatatgcaagattacgccagttttctaacaatgtcatatgtaacaaccttccttttccgtaattattaacgcgattgcgtcagtccgactctagtatataacatgttggcggtttttgcaaaatattttttcttacatttcctgccattcaggcagaaatgcccgctgtaaaacgataatctgcacgctccgcacacaggtcaccgccttcaataaaaaggttctatactgaatgttggggtgtgctgaaaagcacacttccaacattcttttcgttgtaataaaatacatctataagaagcctcctaaacgcattatcccgaccaaagtttaatgttacggaggtgaccccttatagatgtaccctaattataccaaggctttccttaacttggaaggtgtttctattaaaaaagtggttcaggcagactctttcattaaaattttcatccagtcccaaccggtagaacagacttgtccctgctgtggggctaaaacaaaacggattcatgattaccgtttacaagaagtccaggacattcccttactgggaaaacaagtaatcctgcttcttcgcaaacgccgctacctctgcccatactgccgcaaacggttcacggaaccctattcgttcctccccagctaccaccgcaggacccgcaggctggcattttacattgtctccctgctccggcagaccttttccttaaaacagatcgcaaagcttaccggtgtttccgtccagacggtctgccgccttctggacacgatttgctatcctccgcctgaccagcttccacaagcgctttccattgacgaattcaaaggcaatgcttctaccggtaaatatcagtgcattctggttgatccgaaaaagcgccggatcctcgacattctcccggatcggacccaaagccatctggctgattattggcggaacattcccaggaaagaacgcctgaaggtaaagttcttcgtctgcgatatgtggcgcccctacaccgaacttgcacaaaccttctttccaaacgctacaatcatcgtggataaatatcatttcatccggcaggtgacatgggcaattgaaaatgtacgcaaacggctgcagcgctccatgccggtttctctgcgtaagtattataaacgcagccggaaactcattctgacccgctacaaaaagctgaaggatgagaacaaacaggcctgtgatttaatgcttcactatagcgaggatctgcgtctggcacaccgcatgaaagagtggttctatgatatctgccagatggaagcgtatcgtcagcagcagagggaatttgatgactggattgcgaatgcacagagctgtgggatcaaggaatttgaggcctgtgctaagacctacagggcctggcgaaaagaaatcctgaatgcctttaaatacgggctgacaaatggtcccacagaaggatttaacaacaagataaaggtattaaaacggagcagctacggaatccggaatttcaaacggttccgaacccggatacttcactgtacatcataggataaaaaggtcggtaatgcggaggcttatttggcatgccaaaatcagtaaaacctggaactaaacataaaaagggcccttttcatagaattggggcgggattttaacaaatcccaccccaactattgacaaagagccaataaaaaatccggcccgcctacactgctgtaaacgagccggattaaaaaggggaggataagtattcaaaaatttctcttttgtgatacttacagtataacctccctgaattgaattatacacggaagcaaaaatatttttatttatttttcgccggcgttatccggaccaccactaattcgggccggttattgattcggattgggataatgctgtttcccaagcctctgctgacgatcatctccgtttcaccttcagcaaatattccggatgtatatttcggaaataatccctgtccgggcgccaccactcctccgataaagggaagccgaaactgccctccgtgggcatgtcctgccagaaccagatcaattccattgtccacatagacctgaaacagttccggccggtgggacaggagaagtttatatatgcctccgtcacaggatatgtccccgatagcttcgttcattaccgattgggcgtccccgtattccgtccttgcgtaaaatgccggatccttcgctcccatcaggcagatttgctgtcctcccagagaaaacgtttcagatattccatccaggatatgaactcccgcgttctccatctcacgtttcaacctgatatagctttccgctgcccacgcttcgtggttgcctgtgacaaaataaacaggagcgattgttacggcctgcgatattaattccatcgccttcccgatatccgtatgatttgaatcaattaaatccccggttacggcaatgatatccggtttggcttcttttattttccgaatcagcttttcctgcttatccccaaactcagcgttatgtaaatcggaaatttgaattatcgtgatatccggcgcatcaggcttaagtttactgctctctattacatagaccgttgtccggactgctttgttttgccagaagcaccatcctgtaagcagcgcagcaccaaacagagcggctatgaggatttgtctgtgttttaatattcgtcttttctccataatacctcgataaacaaatggctataaaaactaatgcagtaaaatattattttccattacaaaaatttttccgaaatcagcaccaaagctctgctgtttagcaaccagatacgttacaagctgtcccctgtctttaaatatagtagcttgataagggtacaaggggctgattttttccaaaaacaatatatcctcaccatcctcaaccaatacaccagcatgaacggagaagatataagaggaatctttcccttgcacattccctcaaacggtaatcagagacggcctgttattttcaaatgataattccagagttttccaatagctgttaaccgcggctgctctttgttcggcgtttcgacaatctgtccttgttttaacaggttgaaaaacgctataatacttattctttgtatcttctgtccacattatggcgggatttctctctataacctctctgtcccccctcattagctccttatcacagaccatcattgttgatgattgggaatctgttagtgataaaaaatcctctactagatagaatgctaccgttctgcacagtaaatcatcataattcccgcgtttttctgcccaccgttgagccatagaaaaacgcggtacataaaacaccatctctccatccatactcgtaaaaccggtttgcagattatatccttctaactggttgaactcctcagcccacagaagaaagttgcatattttttcctccggcatttgagcttctcttaatttttcagccacctcttcacgtgaaccttcatccgttaaatttgaatagactggaagatttgctgtgactgagcctttggccttgtcaactgctgttttatctctttcttcctctgaacacgatatcagaaatatcataagaaaactcagtattaatatatttctcatactttctctccatgattttccctaagtattgacaggtaaccatttaattctgtttgaaggttccataatctacggcaggaaatttcccgttcttcccgtctttgattttcacctttgcagttccggaaataatctccttcctgctcgtatcatatttggtacatgtaaccacatttcctttatcgttatccgtaattttcctgtcggtaaggtaaagttcataaccattgccgtttttcctcatcacccagcttttggccgaaacattaaccccctgttttttcagttcaatctcaacaatcttcgctaaagaaccatattttccataaccctcatccgtaatcttggtactcgcctcggaatccagggttttcgatgtgtcatttccaaaataatcggccagcgtcttgtaggttttcccgccgctgacaatattatagctttccagattcatctcattcagcagatggctcagcgtgacaatatccattgtccagcccccatgcttgctgcactcaatcgtaattgcattcaaatcatttacaaaacggcatttgtagtttccgtgacttttacatacaccggagaaccggaaaaagatggaggtgtcttcctggctttcactccaattcttatcgcctccgtgttccacaataatttcactcagtaaattaaccgcggtatcctcatccggggccttccccagatcggcgactttggccatgtattcctctgcaataacatccatcgcgtgcagacatgacgcttttcttgctttctccatatacttcataaactgtggagccagcagccccgtcagtatcaataatatcgcaattgcaataatcagctctatcaggctgaaaccgaggttcttctttttcatacgatacaccttttcccattaaagtcttccggctgctgcccggaacttgccgctttgccgaccgtacagttcttgattcattatcattttaccacccgccctgtttaattacaattcatatttccttgaaaggtttagttaagcaggtgaggacgccgccggtacggccagcggacggggtggtggggtgtgtatatgagtctttcgtcccgggagaggattgttgtggtttgggactgcgggcgaagataaagtctgcggagcacactcccgctctgtgaaatgcatcgcgctgctaagctcgtaagggacctcgctaatcagcgatggatttaggcggcatccgcagactttatcttcccctccgccccaaggccaggttttcgccgggacgaaagactccgccaagggtatcgcccgtccgctggactgcggccgctgattgtctcacgcgttaagtgcgggggcggaccttgtcgcggccactcagcgcttctgtgtgtaggaaatacgatatgccttccatgcgcctttttaaagaattgcagaaaaattgatatcagcctgccggaaacacgtagtggccgcgacagggccctcctcatttaaggttggagacaatcagcgtccggaacggaccatgtccggtgtcgcgaaaaccttcgcctgagtcttccgtccctgcgataacctgacccgggggaagtaggcggaatcaattgcggaggggacatgggagtccgccggtgcttagcgaggttcctcacgagtttagcaccgatgcgcactccaaagagtgcaaacggtccccgcagcaattcattccggccggattccccctccacaaccaacctcccacggggacggaagactcagccagccctcaccacaccggacatggtccgttccggacgcgtcccccctaaacctcagttaaatctccataatccggttgaaatgttcctcttactattatagaataaagatatcatacccctgagaaaaaggagacagtacattatgaaaaagaatataatcgttggccagtcaggcggtcccaccgccgttatcaatgccagcctctgcggtgtaatcagagaagggaaatgccaccctgagcaaatcggcactgtttacggcatgattaatgggatcgaaggatttctggccggtaaatatatggatctctcatccgggctgagcgaggaggaactggagcttcttaaaatgactccggctgcttttctcggctcctgccgctttaagcttcccgaaactctttcctccgagttctaccctaccctctttaacaaatttgaagagctgaatatcggctatttcttctacataggcggcaatgattccatggatacggtaagtaaattatcgcgttacgcgaatggaatcggaagcgatatccgttttatcggaattcccaagaccatagacaatgacctggtcgggaccgatcacaccccaggctttggaagcgcagccaaatatgtggcttccactgtccgcgaaatcacgctggacgcctcggtataccagcagaaatccgtcacaatcgtggaactgatgggacgtcatgcgggatggctcaccgcctccagtgtcctggcaagaaaacacggggaagataatccgcttctcatctatcttccggaatcgccttttgaatttgaacagttctctgctgatctcaaaaatgcattcgagaaaagccagaccgttgtcgtctgcgtatcggagggcattgcagattcagccgggcatttcatatgtgaatactccaatgaggcccagcttgacaccttcggccacaagatgctgaccggctgcggggaaatactcgaaaattatatacggaaccagtttggtgtcaaggtacgttccgttgagctgaatgtaagccagcgctgttccggtatgatcgtctccgggcaggatatgaaagaggccgaagaagcgggagccttcggcgtccgaagtgccctggacggcgtgaacggtatgatggtcgcctttaaacgcgcctgtgacgagccatacttgatggagtgcttcctggccgatgtcaatgagatttgtaataaagaaaaaacgtttccggccgagtggattactaagggcggcaccgatatcggccctgagttcctctcctatgttttaccgctgataaaaggggaggccgagcggaaaatggaaaacggacttccgctttatctttaccgggaacaacaataatggcctgcatttacagcagccggtttaaataagggggtacctgccatggttacaattaccaaagaacacgttcatttcactttttccggaagccacaaaccggtgcaaaccgttccctccggaagtacggtccgttttgaaacgtatgactgtttttacaaccagcttcttcccgaaggagccgatatcacaaagattgattcctccaaagccaatgcggcgaccggccctctctgcgtagaggaagctctcccgggtgatactctgaaaattgagattctcgatatcacaaccggtcctgtcggcgtctgcggcacgtttcccggcagcagctgggacaatgggatcctgaaagaagaacagttccgtcggctcaccgtcaaggacggaatggctgagtttgacagtgcggtgcagatcccggtcagacccatgatcggagtgatcggaaccgctccgaaagaaggtgcggtttccacaatgaccccgatggatcatggcgggaatatggactgtacccagattaaggcgggaaccaccctgtatcttcctgtttatgtaccaggcgctcttctgtccatgggagatctccacgccgtcatgggcgacggagaggtctgtggctgcggactggaaattgagggaatggtaacggtgcgcgttaccgtcctgaaagatgctccattcccatggcccgctgccatagcggacgatcgtcttatcattattggggctgcaaaaaccgtggagtctgcctggaaacttgccaccgcgcggatggaggcattcatttcttccaaaacaggcttatcccatgaggacacatccatcctattaagtctctgcggcgatcttgccgtatgccagaccgttaacccgatgaaaacagtgcgcatggaactgcctctgaatatctttaagaacgaatcgggcagatggaagcagccgtaaaacggccgggcaaagagggaggggatgccgctcaatcatcgttttgatgattgagcggcatcccctccctctttgcccggccgttttagcagctatactgcctgattgtgcctggccgtcactccgtcagttccctcacatccacatcgctgtaaaagaagttgagaatctctttatacgtcttgccttccttagccatctgctgggctccgttctggctcattccgactccgtggccataacctccgccccatatggtaaaggtacgcgttcctttttcctcgtccctggccgtctcatccacagctataaaggcgcttggcagggaagcccagtccgtcatcgtggatccgtcatttttcttatagaccagatcggaggcacccagcatatttcggatctgggtctgtcccttcagaactttttccccttcgcttccaatgaccttcaccgtcttggcaatgcctcctgttccccgttccgttacaaaaagtgcctgaatcgtaccgatatcatctatcttctcggcaagcttcttatttgtaattgtcgtggaccagcggtacatggaataaccggagtcgtaattcttcatcccctgcccctggataaacgggacaaatacttcattctttgtcatgtcctccattttcttgtcttccgtcagggcaattccctgcagataaggaacatccttaaggtccgctccccagatcgtgccgtcggtggtatagccgcaggaggttgaaaaataatacgtttccgcaggtgtatcgccatagaaaaccatctctccgtctgtctctttaattgcaagatttgttctctcatttgaatcgatattgttatacacctgataatttgtactgtcatcgacatgggctccgtactgactgtaggcattagcctgaatctgccggtaggcataggttctggcgcagactgcctgggcttttaaagcctccacttcgtaggaggacggcatctcacttggaactaccctggtcagataatcttctatatctacctcattgacgagcaggagcccttccgactccttgctaatctcaaagcagccgaaatactccggagtaccctgctgtctgctgacgctggccactttaatacccttttgccgatcctcgggctccaccgtaagccttccctttaacagacgctcatcgtcctttttgataaccagctccgaaccggcttcaatcacttccgatgaatctccatactcaagatgcagaggcgtgtcggctttcaatataattttatcatggaaaatagaagaaaacccggtgtccataaccaacaccctgatatttttggcagaaaaacttttaaccagaagggcagcacatatctttttatccgccactacaaatttttccaggttgtagcctaccaggatatcttttttcttctgctctttcacgactccgtatgtcttataaaccttgaagtctttgtccagccgcacctctccgtatccctcgatctcaatggaatcgtcccggactgcaagaacctttccctcgatcgtatcttttttcagggacagctttttaatctttcccttgctcagggagacatccgccagcactccgccctcttcctcctccacctcttttgcagatggaaattcccggataatcgtacctatgtagagattcatttttttatgttctccgggcgccagccatacattcctgtaaaccacctcgtccgagaccacagcggacaggtgtatcatctcgccgttcctgatcagtaccttgatctcgtggtcaatataggaatccatggaaagaccctcaaatcccattatcccttcgctggtatacgcagtccagggagcggcttccttcacattgtccggcgtaccgtaaagcagaagctttacctcctgtaccgcctgctgtgtgtccgcggcctttaaaaaggatgggtaaaagagccaccattcttctttgggcatcggtttattatatttcttttttgagatattaagcgcctgagaaaggcccttggaaacttgttcggcagcaaatgccgcctccccgtaagtcaggggggaggatgcatagtcctcatccacaaccgtctcctcctcaatcagcccctgttcaaacagatagtcgatatatttggccgaccattcctctttcagctttgcaggaagacgggagccattctcattctgggatgcctggcactcctccttgtctgtcagcgcgagcgccatggctttcgaggccatggcgcgggaaatataattatctgccgtatcaagcttgacaataatgataatcagaactaccacaattgccggtatcagaaaggtccagtaaaccattttcttcgatctcataaaaatcctttccctatcagacagcttcgtccggatgtccgttttaaccgtaatgactatttaatgaatctgccgtctttttcgtcaatatgatccaaatccttataatcctctgtcgccatagacagtttcttattcttaagagagaaatgcactgccctggcaatcaggtcgtaaatgactgcaaaagcaggaactgcgataatcattccgacaaagccgaacaggcctccgaagagcagaatggaaaacagcacccagaaactagaaagccccgtggagtctcccagtatcttcggtccgaggatattgccgtcaaactgctggagcagcaggataaaaataagaaaatagatacatttaaccgggctgacgagaagtaccaggaagccggtcgggatcgccccgataaacggcccgaaaaacggtatgatattcgtaacgccgattataacactgattaacagggtaaaaggcatcttcatcagcgaggttccgataaaacagatgattccgataatcagggaatccaccagtttaccaataataaagccgccgaacatctgattgacaaaacgcagttcttcaatcacattgttggcccatttgaggttcatgcagctgtatataatcttctttccctgagcagacagagtgtccttgatattcagaagataaaccatgactatcagtccaatcagccagtttttaataaacactaaaagactcagcacactgcttgagacgccggtcagaaattctcccagcctggtcatatcgatattggtaaatgatttctccagccagctttctgccatcgtaacactgttctgaaggttgcttagcaccatcgcctctatatccgggttgtcagccagcacctgctgtatccatgcataaaggttctgcagatacgtcgggaaagaatccctgattcccatcaaactctctatcatctgcggtatcagcatctgaaacaggcctgccacaatgaccagcactaaagatacgctgacgaatgttccggccgccttggcaagccccgtcacatgcttttcatccttccataccttcagcagtttaagcttcactgctttggtcactctgttataaatcggcgtagtaaggtaggccagcaccgcgccgtagataatcggagccacaatcccgattatcatgtgtattacccgggccacctcggaccaatactggatgcagtaccaaaatacgatgcagaccgctatcacggcaaccgccgtcagccccgtataaatataacgtttaaactcattgtttttcatgtttttccctcatccgtaatcaagcgttatgattcacagccgtctctgtgcatcggtaaccggtgaatcaatcgttattgttcacacggttgtgttccgcgaggttttttcgtgcgcattctgcacgaaaatcccgaatttcacggcgcggcgcggcaaaaaataaacttttcaccacggtaaaacatgccgcgcccactcaggtccgcaacataattcatcatcagtatacaggaagcctgctatatttggcaagtaatatcatgtgaagaattcttaacaaattctaaatcagttactgttcactccccgccggacaccggcgcgctgctcataacgataacctgtacgccccgcgcatcaccggcttcaataacacgctgcgcgccgatgcgcacatgtcaccgcctgtctcttttgtgttcttctataatgatatccgcaaaacggctgcgttattccaattcctggaagtctttccaatctttgccgtcaatacaggcatcatcggcattccaaggagattgtatgaagtttgaaagtgaaacataagatatgcagaattgcagagacggacagaaatttcaaaaggatcaggctccggttgagggtccgaagccagagcagggaggtcatagcccctcaactgttaaacgtatcaggggccggtgtgtgaccgctgtctttgattgatgacggtgacctgtgcgcggggcgtacaggttatcgtttatttattaatatttatctggataaaaggttttcccttttgtgctttccgccttgggctgaactgggaaatattatacacctcgttatataatttactcagctcctgtaaaccgctgttgacatcatctaattcattgtttgccatagactcatcaatggtctccatctgtgccttaagaagcgggtctatgtatacatacagccggcagtaattaattttgtattcccttctgttttcaggcgtgtcctctgcgatacacttaccgatactgcctgcatattgttcgtaaagattcagacaacggtaatccttttctttaaaaccggtggatttccagaatgcatatcccgccattaccgcggcaatgagcgaaattattacgctccagacatttgcgtcagcatacatactaatctttctcccttcgtattttattcatcataccacaaaatccggcaaaataatactctcaaataaataccgtattccattgacccgggcaatactctgtcttcagcaaaaaaacaaagcagcgagtaaactcgctgcttcttatcgtttgtaaccccaaaatgccggctcttacagtattgacgcctagctctgctaggtgggcaacctcacttaagcttctgccttccactcataggaggcctgacatccgcttaaaaatattggaatcccgttatgtccgatgtaggttcaaaaaaagtaagagttatcgagcattccaggaattacaaatgctctttttgatatcgttattatacaccagttttttgtctttttcaagctccatttactggccctattcttaaggttttcttgtgcagccgattttttccctgttttcaaggattttccatttttattttaatcaaaccgtttggttccatccctgcttaccctggcatataccagcatttttttctccggcgcggactctgtaaaatgataggaggaaagaagctttgccccggctgcttcgaaaagagtttcgtctgaggcaaaaagttccgccaatggttcccctttctgtacatagtcgccgtacttcttatggaggatgattcctgctgaattatctatcacatcttctttcgtgctcctgccggccttaagaagaaccgaggcgattccgcatccttccgtatccatgtggccgacatatccgtcctgcagagccgtcaccttcctgctgtacggcgcctttaaaaactgtttgggattctcgatgaaagaaggatctccgccctgagccgccaccatcctcttaaatgtctcaaatgcccttccgtccttcaaagtctgctccgccatcccataacagcttccggcatcccccattcccgccgtatgcagcatctccgcggcgagtctgaggctcacttcctttaaatcctccggcccatttcccctgagcgtttctactgcctcaatgacctccagagaattgccgattgcagctcccagcggcacatccatgtccgtgatcaaagccgtacaggaacgcccggccccattaccgatggcaaccatctttcctgccagggtaatcgaatcctcaagcgttttcataaatgccccgctgcctgttttgacatccaggacaatcccgtcgcttcctgccgccagctttttgctcataatggaggaagctatcagtgggatactgtcaaccgttgccgtcacgtcgcgcagcgcgtaaatctttttatccgccggaacgaggttgccgctctgccctaccaccgcaatcccggtcttttttacaatatcaaaaaattcgctgattgggatggcagtcctgaatccgggaattgcctcgagcttgtcaatggttccgcctgtatggccaagcccccttcccgacatcttagcaaccttcactcccagggaggccactaccggccctgccaccagtgtcgtcttatctccaactcctcctgtactgtgcttatcggccttaaatccttcaatcggtgataaatccaccatgtctcccgaatgggccatctcaagcgttagctgtgtcatctccgtatcattcattccgttaaagcagattgccatcagcatggccgccatctgataatccgggattgcaccttctgtgaatccccgaaccataaaacgcacctctgcttcatcaagactctcatttcttttcttcttttcaatcagatcatacatcctcataatctcagcctcctttataccgaactgttacagattttcaggcccaaagctcacaggcagcagttcttccagggaatatatcctgtagtcctcctcggaagcggccaggattatctggaagctgtccaggctgcagaattctctcattacctgcctgcatatgccgcagggtgcgcagtagccggccagccggccgttttttcccccgcatattgctatcgccctgaaatccctgtgcccttcgctgacagctttaaaaaatgcggtccgttcggcgcagttggtggccggataggaggcattttctatattaacgcccgtatggacagagccatctgagcaaagaagagcggatgccacatgaaaatgggaatagggtgcataggaggacgcaagcttgtcaagggccgccctgattaaggcctttgcctcttcggctgtcactccttggctgacagaagcgtctgcctttggccggttcacaatggtttcattcttttcttccatctccattcatattcctccttgaaatgttctttacaaagtggatcagcagcatagcaatcacggcaaaagcaatatagccatacaccggataaagcacggaaatcagactgccgaaccccagctggctccctgcccatgctgccaatcccaaaactgctgaaaataatgttttatgcttcctgatacgctcaaaccggctgaaatacctgggaaccggcgtgaataccgacatggccgctcccagcattgcacagagcagaaacaacgcgcaaatccaggcgagaagcgggtggaccatcccggcaagagtcaggattggcagttgtgtgtctgccgccgccttctcggaatgcattgccagcaccagacagagcccgataataaacaggaacaggccgcccgatagtacgcctttaacggccggtttccttgaactgttggccaggccgagcggcgccagcgcaccgatggcgcagaaaaaattataggaagtaaaattagcggccgcaatcccccagtttcccagcaaaggattggaggccgcatcggcagttacctcaatccgggcaataccgtttttaccgatgacaatcagcgcagtgacaatggtcagcgtcaccagcaccggaacaacgcggccgaaggtcttcaccacggcttccacgcctcccagagatattaccgtcacgatggcgcagaacacggcgctgcccagtatccgagccagatggctgccggtctggctctcaatcaaagtcccggctccggaagccataaccgtataaatcccaaacataaaagaaatctgcaccgctcctgtcaccccacgcagccatggaatatccgacggaatcacaacacggtccatctctcccgttccgctcattccggccgtcaaaagcagtatgagatccaggcctgtcagtatcagacatgccgtaaataaaccgagaatcccctgtattccaaagcagccgaagtactgccaaagctcctgtcccgagacaaatccggcgccgagaaagcagcccataaaagtggcgcaaatttgccgggtacctattttttccatctatctcttcccctgatcaatgtatttactattatgatacgttttaaccggcaggatggcaagtgttttatattttaagaaaaaagcggacagaaatcatggttctgatcctgtccgccgcacccggtattccgcccgttaactttttatctccggttataactgttctttgataattttgactacacggcttgttcccagacggtcggctccaagctccatgaaacgcttggcatcctccagggaaccgattccgccggccgccttgattttcaccccgctgccgacatgggccgcaaagaggctgatatcatcgaaagtggctccggatgtggaaaaaccagtggaggtctttatatagtctgccccggcctctgtcacaagtcggcacatcgtaatcttttcttccctggtcagaagacaggtctcaatgattaccttaagaatcttaccggcgcaggcctccttaattgcttttatctcatggagaatctgagcctcgttaccgtccttcagatccccgatattgataaccatatcgatctcgtcggcgccctcctctacggcagtcctagtctcaaatacctttaccgcctccgtattatagccgttcggaaacccgattaccgtacagatacgcatcccgtccccaacatattccttggcccgttttacaaaggaggggggaatgcatacggacgcggtgtggtacttcattgcgtcgtcgcaaagctcttttatctgtgcccatgtagattccggatgcagcagagtatggtctaccgctgcaagtattttttctttattcatattatcatctccctgtttctccggagcgtgtctgaaaatttctttccatcaaatatgcatcacacttggcggataatttggtccaaatgaattttcagacacactctaatttattatttcaaaacttcgttcataaagctctttcctgccgtctcgcccggcacttccagatattccagcacggatgcggcgatatcggcaaatgacgctctggttcccaggtttatcccggctttgaccggcgctcccgcaatcactagcggtgtgtactctctcgagtgatccgtggacggtgtgctcggatcgcagccatgatctgctgtaatcataaggatatcctcctcctttaatgccgcgagaatctgaggcaggcgctcatcgaaagaggtcagggctttggcatacccctccacgtcattcctatggccgtaaagcatgtcatagtccaccagatttgtaaagcagattccgttgaaatcccgctccatccaggatagcgtcttatcgataccgtctgcattgctgactgtccgcaccatatccgtaacaccgcttccggcaaaaatatcattgattttgccgactgccagaacttcctttcccgctccgctgatgtaattcagcatcgtggacttcggaggctcaagggaatagtcatggcgccttgacgttctgctgaagggatattctccttcaaacggacgggctattactcggcccacgccaaactttccggtacagaggcgtcttgcaatctcacaataacggtataattcctcaatcgggactatctcttcatgggccgcaatctgaaatacactgtctgcagaagtataaacaatcaatgcaccggtcttcctgtgctcttcaccaaaatccttaattacctcggttcctgaatatggtttattgcagagaacctttcttcccgtctctttttcaaattcatccagcagctctttcggaaaaccgtccggaaaggttggcagaggctgctctgacacgaggcctgcaatctcccagtggcctatcgttgtatcttttcctttggaccgttctgtcagcctcgcaaatgcaccggccggagctgcgctcccttcccggcagtccaccccgtcaatattaaaaaagccaagtttctgcatgttcggcatggaaaaggaggggctggaagccgcggctgctatcgtattgctgccggcatcgccatattcgtctgcatcaggcatttctccaatccccacactgtcaagtacgattaaaaaaacacgtttcatttattttcctctcttttcttttacaggcatacggcgccggaaagcgccgccttatttgtttcacatttacaagtatataacaggttgcttctgttgtcactagcatggcttgtttttttcattcaggtctgttaatattgtaacagtttaaacaggtctgttactgtgattattggcaatttaaagtatttcagtcgcataaatatttttgaagtcattcaataagacgcgtcgtttatataagtgagacagatgagaaagggggcggtcctattaatgcggaacagcagctggaacaatggataaaccagtatcagaatttaatatattcaatctgctacaaattcaccggcaattactttgatgcggaggacctggcccaggatacttttttatctgcttacaaaagcatggcctacttcgacggcagcaacgagcgggcctggctttgcaaaatcgccaccaacaaaagtctcgattacctgaaacgggcaggcagaaaatcagttcccactgaagacgtctatttttccgccatcgctgcgcctgaatcggttgaagagaaatacctggaaaaggaggtacgacagaagctttacgactgctgtcttgccctcaaacctccttaccgggaggtggcccttgactactattatcacgagatggaaatcggtgaaattgttaaaaaaacaggaaagaacataaaaacactgcagacccagatatacagggcaaagggaatgctgaaaaagctctatggaaaggaggaacctgcatatggaaaaacagcaacacattaatccggaatattttaagacgggactcagtccggaagagtacagccatctggcagcctgtccgttctgctgtgaacaatttgcagattatattgagaatcaggaactgattacggctcctgcgcacctgaaatcctccataatggagcgaagcagggacctggatgttcagattgtcgccggctccaatcatctatcaaaacggcttcagcttttctatttcagcctgaaggtgggagccgccgtactatgcgcgctgaccatgctgacgattctccccggcgtttccagggaaatttcagccagacaggatgcagcggccagacagagtaaattccggtcggaacagcaatgggactattacgaaacggtaaattatttaacggaacagcttggaaggctgtccaatatcaatatggaggtattcaagaatgacaaaaaagaaaggtaaattactaacattctgctggtccctgattcccggcgccggagaaatgtatcttggatttttcaaacaggggatcagcctcatggccgcctttgcagtattgctcggaatatcggggtttcttcagttgagtttcctgaccttcctatccccgattgtatggttttacagcttttttcataccaataatttaaattcattaagtgacgaagaattttatagccttgaggacgattacctgatccacttcagtgatatttcatccaatcaggataccgttaaaaagcattataagctgatagccggctgtctcatcttttttggaatcagtgttttgtggaagctgttttcgcggatgttattctggtatatcattccggccctgtatctgaccgacgaagcggctgaactgattcgttttatcaccaacacgattccccagggagtggtcgccgttgtcatcattatcgccggcatctacctgattaaaggaaagaatgacgagctgaacaaggagaatcacgatatccccagccctccttatcttgaaaacaaggaaaaataaaaagatataatgatgccttcaacttaaaaagccatgcggtaagacgagcccgcatggcttttttctatctgttctgctcccaaataccggacagtaaaagctgttccagttcctcaacgtccgccgccagatatccggcccccgcctttgtaagttcctcctgcgaaccatatccgtaaagcacaccgacacagcttattccgtgttttgctgctccttccacatcatgtctcctgtcgcccaccataatgaccggattttcttccggatccgctttgaggcggttcagggtatactctatcacatcgccttttctcactctggtttcctccatatcggcaccgcccaccagcttaaaacaggaaagaaggccaaaatgcttaagaatctgctctgcaaacacttccggctttgatgtggcaacagccagcgtatatccggcttccctcagccggttaagcatttcctttatgcccggatatactttattctcaaacatcccctgttttacgaagtactcatgaaataccggaatggcttcccttgcatccttttcagtaaaaccataaaactcgataaagctgtccgtaagaggcggcccgataaacggacacagcttatccagctcctctacttcaattccataggctctgagggcatgctgcaccgattttgtaattccttctttcggatcggtcaatgtaccgtccaggtcaaacagtatgattttttccacacttctctcctatctttctcgtatattgaatatgatatttaatcatgaccacccgtcaaacgggtggtttgctcgcccctataaggggacagttaccggccagcgcctaaagacgctggctttcactctgttcaagccactatgcccttgactcgtcgcctccctttaaagggcgtttgtaataccggctaccccttaaaggggtcctcatattcctttacactcagtttatccattgctatatcatacttctcctgttcctgaatgtacttcctaactgttgcctcatttagacctactgtactgacataataaccttctgcccagaagtgacgatttccgtatttatactttagatttgcgtgcttatcaaatatcatcagcgcactttttccctttaagtatcccataaagctggatatactgtatttcggtggaatacttaccagcatatgaatatgatctggcattaagtgaccctccagtatttccactcccttatatccgcataacgtttttaatatatctcgtatgctttctttatattgattataaatcatttttcgtctatacttaggagtgaacacaatgtggtatttgcacatccactttgtatgtgccatatcatgtttcttgtgtgccattaaaatcacctttcctttcttagatagtagcttgaacaactctattctatcggaaaggtgatttttgtgctataagcacttgctgcaccacccgcaaagcaggtggtttcctgtttcaggcattatcatttttcggaacacgaaaaactccaatgccttcaactggctaaagccagaacgattgcctgcacgctccgcgcacaggtcaccgccatcaaagaaagaaaggcggtacagccgctgccataccgtctttccatattcccgttatcctcttagcctaattcgtcaaccactttctgaattgcagccattgcgtcatcaggaagtttatcatagccctcttttgctacggcaaactctttaatctcatttaaccggtcgttcatacgcgccttaagctggcttacgtaatcgtgatcttccatgttcgggataaagccttcccaatctaaaatctcgatatcggagaatggaccccacttgtggaacgctgcccgtttttcaacaatcgcctccagaattccgagtgtatcggacggttttacctttttgcccatgaaatcaccggtatttacaatatagcagtcaacattcttctcttctaccagcttcttgaacttatcatagtcgttcgacagcggataggtgcggaatggattagcatacggaacaacgaccagtttgttcggatctgctcctggagccagacgctctgcggaagaccgtttggtagccagcgtagcgcccatgacggaagccagggaagcgcctttaagtttaactaccggaggaatcgtaggatccttcataatccagaagatcgcattaaccggagagtcaactctgtccacacggttcggggaccaaagtttagatttgatggcacgtccgttgccgttacggatatcttccgtaacaagctgaatcttaccgtcctcatctaaagtggcggaacagttctgcgctgtcagcagatatttattatcctcgcatcccgttggataatcggccgtcttatcaaaataggtcggctcgagagcaacggaagcacatgtgtctgtattgataacgaaagcatcatcatgaagaaccttgatctcatacttaccgccgtgttttgcatgggtaagcgtggatttaccggaaccggacaggccgtaaacagaagcaacatatttgctgccgtctgccagtgtgtattctttctgtcctccgtgacaggatgcatagccgttacggtttgcaattgcccatgccatggtcagggttcccttcttatgctcgccaaaatatctcatgccaaggatgcaggcgcagtttgtctccgtattaaagtagcacagagtcttcttctgcggatcggacaggcagtccagggaaacattcggacggtcggaaccgttccactgcggatcggagaagatatagatatctgcttcttttccgtcgcctaccggtttggaattcttgtacatctttacatattcatccgacatgtactggaagttcagcatccagttatacatgatattttcttcgccttccggaatcagcagatgggcttttaccataaactcagggtccagtcccacaaacacctctgcgtgatacatagttttccagcgtgattcgtaaatagcgtccatcgcaacgagatcgagtgccgcacaatctacacctggctctccggcaatacggcgtgctgttgcatagcgtcctgtaatggctccgtcgttaaataacagaacctttgcatccttctccaggccaaactcttctcctctgtatacaggcatgtccgttacaaccgttcccggagaattcttagctaattcatatgcttcctttaaggtgtttactttcaccacattgtttccgtagaaagcagcctcaataatggatcttgtcttagaaaaacctggctttccagcaccgatttcactaattgggtagtacgcttttgttgacatattagtcctcctttatactgcacctcaaatttgtatcaattatctcactttgttaaacaaaagtcaatccctggcatcataaaattattatgaaaggtattataaattttttagtaaagcggaccggtttcaacaatccgttttgtatacattgtataccagggaaaggcagtcaccgtcattgtgtacaaccggtaaccggcattcctgttctctttttaccacaaaacagccataaccgaacacagtaccctgttaaatgaaaaaggcacagcgaccgtatctctcggatccgatcctgcgcctctttcgttaattgaacttttattagaactctttatttaaaaaattcatgccttccatgctgcatcacaaaggacagccgtccgtcaaaccatttaatattggatgactccgatccgccccggttcataaagtacaatgctccctgggagtaatcttcccctgccagcgcccgatccacgcagtctatcgtctgctgggtgactctgcaggtatttatgcttccgtcaattaccggcgaaaactgggatctctcatacaccacgtccgtaatgttatttggaaattccttgctctttacacggtttatgatgacattagccaccaggattttacccttctcatcacagattcccgcctcggcctgaacaattctctgcaggaccctgtaatctccttccgaatatttgattacagcctgttctttcttcaggcgcgcgcgctcctcgcgttctttcaccgctgcttcttccgcagcctgctgtgtctgcatcaggacctctctctcgattgcctcgatctccagtgcagatttcgcaagttcatcctgtatgtttttttccagcagacttcctataagccgctgcccctgttcttttgaagcggtaagcagaacttccatgtcagttccaaagcttgtactttcttcctccgactgcatcatgtccggcagtttttcttcctcatcattgttctcgtgataagctgcggccgcggttttacctgcgcctgcaaaactgctggaattaaaagataccaccgtcacaactgtcagtcccgtaaacagcactgcggctgtacggtacattttttttgtcacactaacaaccaacgatttgacaaaatggtaagcagtctgaagaaatgagtaaatgttcggcatacactctcctctttcttttcaactctttttttgttttgcagtgttcaaggggatgcctgtcccactgcctgtttcaagtgacggtggtaattatatgggagtttcgtaaaaactgtcaataactttttaacatttttgtgacatctcacagatacgcttaatttttccttaacacttatgttaaaaccctacaacaaatcaaccgttttttaccataatttttatatattttggcaaaagcttttttcatagtctattacatatatagcaaattcttccataagaaaatcgtgtcgttttatgacgcctgttttttatgtcaactgttttactgtttttttcactcgttcggaaaggatttaaaacagttcagacagtatgaactttcacgaggattttcacatttatttccatgctttctgctttttctttatatgagaggggcaaattccgcctccagataaccggccagcttatccggctctaccgatatctggacaccgcgctggccggcgctgaccgtgatacggtcataaagtatcgctgtttcttctatataagtagggaatctcttcttcatccctaccggggaacagccgccccggatatatccggtcaacggcagaagatctttcatgtggatcatctcaacttttttatctccagccgcctttgccacctttttcaaatccagttcctcatccaccggaatacagcagaccagataccccttcttctctcctttcagtacaagagtcttatacatgctgtcatgttccactcccatcatatcggctgcatggctgccggataaattgttctcgtcaacctcatactcgcccggaatgtattcgattccggcagcgtcgagaagtcgcattacatttgtttttgtcatgattttcacttcctgttggtaaatttgagcatttatagctgcttatgctggttatattaccatattgcgggggaagggtaaatagagatttagttaagcaggtgaggacgccgccggtacggccagcggacggggtggtggggtgtgtatatgagtctttcgtcccgggggtttggcatcgctggatggagaaggagatactgtggttttgttttcgcaaggcggagccggagagaatgatatccggctggactgcttcttcgagggatagctctaagacagaggaaggcaaagccccccggggttacggacaaattcgctccgaactccgaatgagttcgaagctcaagttgtcccggattttgcccttgtagggctaaaatccgcccggcgcactttgtctccctctgcctaagagctatcatctctcgggcgaacgtccttccggatatcattctctccttctccgccggaagatgtcggcagtatctccttctcccggaaggttttcgccggaacgaaagactccgccaagtgtatcggccccgtccgttggcctgcggccgctgaatgtctcacgcgttaagtgcagggcggaccttgcgcggccactaagagcttccgtgaacgggaaatacgatatgctttcaatgcacctttattaaggaattgtggaagatttgatatcggcctgccggaaacacgtagtggtcgcgacagggtcctccccatttaaggttagagacaatcagcggccggagcggaccatgtccggtgccgcgaaaacttccgcctgagtcttccgtccctgcgataacctgaaccggggaagtaggcggaatcaattgcggaggggacatgggagtccgccggtgcttggcgaggtccctcacgagcttagcactgctgcgcactccaaagagtgcaaacggtccccgcagcaattcattccggccggattccccctccacaaccaacttcccacggggacggaagactcagccatccccctcaccgcaccggacatggtccgttccggacgcgtcctcccaacctcagttaaatctccatttgaaccggctgaaacggaaccgatgcaataccgacataccactcaatctccggcttttcctcaaaatacatggaggaacaggccgccctggtctccccctgcgtcaaaacggcagcaccggctgcgccgccgataacactggctgcaattgaactgactgttgtcttattcctaatcggtgaatccggcctggcacagtcgtggaccgtaaggatatcctctctgctgccggcagcttccccggacttgccgtcagactctgttctatattccaatacataatatttttttggtaaaacaagcccgctttcacccctatgcatatccggcataccgcactccaaatcatccatcgttttacagcggcatgacagaatatggagccggtattccttctcccggcagcgatgcggtacggtcaccgtgaacggcgtgcagtttactgccgttgtaaaacggtagccggaaggacgggtcaccctgtttgatgaaagtaacaggctcattgattttatatctgccatctccctctcccaatgaaacacagccctgtaaaacaaccaggcggagtccggggcaagaccgtacaattgcagcagttccttcgcccggatattcccttcaccagaatcatccggctgccagaccgttttgttccacccgctaccccttatttcctctccgtttatctcaatactaaatttgacgggaagccgcaacggatcatcgcagtttctcagcgcagactgctcctgcgtaagtaacgctctgtctttatctccccatttgtcccgaaatgaccggagcgcttccaccggtattctccggcaaatatctatgttaatttcctgagcatcggagtatgccgccggtatcacccactcataaccgccgcagtcaaacactttcctttctatatgaatcggacttccgctccctttatctttatcattatttctgtaattttctgctttcactctcttcacctacggttccctcttcctttttatatattgttggctgtttattctcgtgttataattttgttaaaattccctatattgatgttataattccgttaaatttttaattttatctgaatatataagtattttgttatatagtatttagctttttatatattatttgtaaatattctacaaatcagataaaatatctcatatcccgggtatctaaaagcaatccaatcaatccaattacagggcaggcaattacataaaaaaaccgcctgtcccaaataccggcgtgccggatatggcaccgccagaatcaaatagcattctggtgatatgtcaagaactttttgaaaaagattttgatatgtttttcagaaaaaagggtaactttaacagaccttcggtatgctttgcacgaaaccgaatgtcagttcgactcaatattatattcggcgtccagcttttcgccggtgtacagttggtttttgaccagcaatccaaaaacgagtcgtacaaatttacgagatgtaagcgcgagtgctcttttgtgctgatgtttggttacctcagcatattttctggcatagaaatcagcatattcagggatgtgcttcctgacgctgtttgccgcttcgccaagatagtagcgaagatagggatttccggctttcgacattttgttgtcctcagaagtaaaatctccggaatcacccttaggccagtaaagcccggcatatttggcaagggcatcggatgaatggaacgctgtgatatcgcctatttctgataggatcccagatgcccataccggaccgattccaggtatggattgaaggatgatcagagcgttagggttcattccattgatgcatttctcaatcgcctgttctatcagcttgatttctttctgataggcatggatgcagttaaacgagcttgccagtgatatgttcagtggttcgtacatgcacttgcctaaccggtaggaatccctggctgccttgcgcagaagttccgaagtttttgataggtcagagatgcggttcctgctcttccccgcaaggaaggtaagcagctcctcttccggcatatcgataatctcctgtggagacaaaaattccgtcaggacagctgaggacgtggcaccatagagactgccaaaaggcttgtcatcaccttcaagcagctgaagttcactgaacttcagataaagattagaaaccatataagtcttctccctggtgatgcactcagaaaggtgcatacggtgccttgtaaggcgtttaagggctatgaactgcccgccgcgccatggctccagttttttcgtacggcctaccctgccaaagtctgcgatgagatatgcatccgtgggatcggtcttttccattccgatataggactttcggtaattcgaagtggcctttgggtttacacagaagacgtaaggcttgtagggcatgagaacctcgctggtcgataggaagtttgaaatatggacgctgtatacagaagtggattccagcacgataagaaccgtatccaggtttttatgcttgtgcatacactcagcaatcatattaacaagcttatcggcacccggctggttattgccaaacgatgatgagatgtatttgttttcctcgaagtccatagcatagacagcattggtctttgagcttacatcaatacctacaaacaaggtggacatatagttgagctttaacatgatatcacctccattccgatggggatttgtgaagcctgaagcaaaaggtttatcctgtgctgcatacggtgaccgaaacctcgcgcaatgagcatgcacccagtcagccttttttgctggggctaccggctggggatgaaaattctgtgtaagcggaatgtgccatatgtgccaggctgaatgctatagaagcagtctcggactaagccggctgaaaggaggagaagcagtgccttcggacatcagactctgctgatatcataacacagaataaaccatattaaaatgtaacgattaactgtatagatgggaatcgggatgaggggagttcctcttagatatccttaccatttataccaaaaaagaataagtctgtaagctgtttttcttgcttacaaacttattatacgaggaggattatttatggaaattaaattggatatgacacaaactgtctgtttgggggttctggtatttttagctggtcaatttgttgtcagtaaagtccattttctggaaaagtattgtattcctgctccggcagtcggcggattgttgttctccattatcaatatggccggggttcagacaggtgcttttcaatttgcatttgaccagacattaaaagattttttcatgatcgcattcttttcaaccattggattcagcgcaagccttaagataatcaaaaaaggcggaattgctatttttatattattctgtacttcctccgtcatgctgattatacagaatgtatggggggttgcaatcgcacgggcatttggcttaaatcctctgctcggcatgtgcgcaggctctatctccctgatgggcggcgtagggtcgtctgccgcttttgctccgattatggaacaaaacggagccgtagggggcctgacttttgccattgcatccgcaaccttcggcctggttatgggcggtctcgtcagcggccccatcgctaaatttctcattgaccgccataagcttaaggacgtaagaaaaaccggcgttaaagaggtggattacggcagtattgaggtggatgaggaagccagtgtgattgaggtgtcttccatgcataaggcttttttccaaatcataattgccatgggtgccggaacagtcatatcaaaattaatcagtctgagcggaatggttttcccggcctatgtaggcgcaatcttcgccgccgcatttatcagaaatggcggagaagctgcgcatatcaaggtatatacgaaagaaatcgatgcgttgggcagcctgttcctgaatatattcctggcaatgaccatcatggccctggaattatgggagcttgcagcgcttgcacttcctctgattatcattctaattggccaggttattcttctcgcggtatttaccgccctgattatttacaatacaaacggcagggactacgatgcggcagtcatggctgccggtttctacggctatgcaatgggggctaccccgaacgcaatggcaagcatgagcgccgttgtttcacattatgaccgtccgtctccaaaagcttttttcaccgtaccaatcgtaggcggctttctgatggattttgcaatggctattctcattatcactcatatgaacctgatactggccggggttctttagatattcccacagccgggtattcctcttgcagacacagccagggtaatacccggctataccagaaatttttctgccaccgctttcagagcgccgggattatcacgctgccaccgtataaatccctttccggacgcttccaccgccttgcccaaagccaggataaaatccggcgccttctcatccggtatcactcccagtttctcccccatccgctcgcttccctgacgttcgcagccgtttatactgagctgccaggccggtaccgccgccttttctattcttatgatacagccctgaaagccaagctcaccaatctgatgggtcccgcaggaggaaggacagcctgatatgtgaatctgtggaaggatcccgtctgcaaattgagcctccctggaagcctgtacgagtttctttaagagcgcctgcgaatcgccgataccctgctggcatacggaagcgccgatacaggcagccgatgcctcgaaggccgtctctgcgcccccctccgtcaccttcagaaccccggcagcttcccgcccgtcgcagtttatgatatagaccgccccgccgggggtcaggcgcagctcaacctgttccatatccctgatcacattataaatttcccggaaaaaagacggcttcgggcttccgcccacaggatggtacaatacgctgtacagccccttttgcttctgctctattacccggggatgatcaggcgcaggactgcggccttttttgctcaccaagacgcacctgggattcatcctcaggttttctccgcaggtgagagccgattcaagcatctcacgaaatacctccctgtaacgttcttccccgcccagggcctctggtatgaaccggcttctggctttagcgcggttctcataatttccatattcgagatacagatcatacatggcctttacgtaatacagaatttgttccggctccaccccatccgccacctttatgccaaaggacggattgattcccagacctccggcggagtatacgtcaaacagcccgtccggccgcgctgcaaatccaagatcccggaatgtcgcatgcgtaagattttccgcagaatttgaaaatgcaaccttcagtttcctcggcagcattggcccgtgaatccggcttaaaagataatcggagaccgcaagagaataaggcataacatcaaaatactcctccttctccacaccggaaagaggggataccataacatttcttggaaaatctccgcctccgcccctggttataattccatgctccagcgcctccagggcgatcctgcatacggttttctcattcaggttgtgaagctgcacggtctggcaggtggtaaaatgcacaagatcgattccgtacgtttcaatgcatccggccacaaatgccagcttgtccttctccagacggccgcctggaaggcgcagcctcagcatgctggcattgccgcctctctgtgcataacttccaaatcctcctgatatgcctttatacgttttcgtatccagcgtcttattatagaaacgtctggtagcttcgataaattcccggtaatcctgtttccactgttccggttccagatttttgggttccatatattatgtcctttccctgatatcctaaaaaactttgacataatatatcattcctcagccgtttcatttcattcttccaaatatagccttgttacaggtgattccggcgcagctgctccatcgcccattcataatccttcttatgtacgtaaaatgtataggagcattcgtctcttgccataagtgccatcgccgccggtcccatcccgattcctctcaggctcccgcccggctttcctgcgccgctgcttactttgaaggtataattaatccctgccagggcgagagtgtccctgacctctgcctgtttttgcatattctgtgtgacatatacttcccttcggttaaagagtgtcagcatttaactccctccttttttatttttcctgtatatcatatatccggccgtgataaggactagtatcgcagtgcctatatataccggtgtgaaatcaatctttcccgctataaatattgcggtcggaccgtcggctcccccgattatggaaacggccgccgcatcctttttcgcaagatacaggccgccaaggctcagtataactgatgcccccgttataataccaagaataaatccaaccattttctcttttcttttcatttctatcttcctcttttctttatctctcaaatcccagaaatctggttccctggaatgtcagacgcccgctgtcaccttctgcaagcataccgtattcactgcttttcaccgacagctccatgcggtctccgctctccacctgaaacgttacgtaatagctggtggacgaagtcatatgagtgccatgagcgcctgtaatatcaccggcgttgtgatgagtgtggcggctgacatgagtacgcttcgccacgatcgacgcttctacggtcagcctgggagactgattgttcttattccactccccgataccgcggataattgtaaaaatgatcaggccgaatactgtaataaaaatcagggtaaacattatctcaaatccgcctccgaacataaatgaatctatatacattactctcctcctcgtataataagtttgtaagcaagaaaaacagcttacagacttattcttttttggtataaatggtaaggacatcaaagaggaactcccctcatcccgattcccatctatacagttaatcgttacattttaatatggtttattctgtgttatgatatcagcagagtctgatgtccgaaggcactgcttctcctcctttcagccggcttcgtccgagactgctttgaaagcattcagcctggcacattcggcacattccgctgacacagaattttcatccccagccgttagccccagcaagaaaggctgactgggtgcatgctcattgcgcgaggtttcggtcaccgtatgcggcacaggataaaccttttgcttcaggcttcacaaatccccatcggaatggaggtgatatcatgttaaagctcaactatatgtccaccttgtttgtaggtattgatgtaagctcaaagaccaatgctgtctatgccatggactttgaggaaaacaaatacatctcatcgtcgtttggaaataaccagccaggcgccgatcagcttgtaaatatgattgccgagtgcatgcagaagcataaaaacctggatacgattcttatcgtgctggaatctacttctgtatacagcgtgcatatttcaaacttcctgtcggccagcgaggttctcatgccctacaggccttacgtattctgtgtaaacccaaaggccgcttcgaattaccgaaagtcctatatcggcatggaaaagaccgatcccacagatgcatatctcatcgcagacttcggcagggtaggccgcacgaaaaaactggagccatggcgcggcgggcagttcatatccctgaaacgccttacaaggcaccgtatgcacctttctgagtgcatcaccagggagaagacttatatggtttcgaatctttatctgaagttcagtgaacttcagctccttgaaggtgatgacaagccttttggcagtctctatggtgccacgtcctcagctgtcctgacggaatttttgtctccgcaggagattatcgatatgccggaagaggagctgcttaccttccttgcggggaagagcaggaaccgcatctctgacctatcaaaaacttcggaactcctgcgcaaggcagccagggattcctaccggttagacaagtgcatgtatgaaccactgagcatatcactggcaagctcgtttaactgcatccacgcctatcagaaagaaatcaagctgatcgagcaggcgattgagaaatgcatcaacggaatgaaccctaacgccctgctcatccttcaatccatacctggaataggtccgatatgggcatccggaattctatcagaaataggcgatataaccgtgttccattcatccgatgcccttgccaaatatgccggcctttactggcctaagggtgattccggagatttcacttctgaggacaacaaaatgtcgaaagccggaaatccctatcttcgctgctatcttggcgaagcggcaaacagcgtcaggaagcacatccctgaatatgctgatttttatgccagaaaatatgctgaggtaaccaaacatcagcacaaaagagcactcgcgcttacatctcgtaaattagtacgactcgtttttggattgctggtcaaaaaccaactgtacaccggcgaaaagctggacgccgaatataatattgagtcgaactgacattcggttttacgtaaaatataccgaaggtctgttaacgttacccttttttctgaaaacatatcaaaatcttcttcaaaaagttcttgacatatcaccagaatgcttatctgattacagtatatcttatttagcctccccgttttttacttttttctgacaaattctgtaaatgtttcattcttatgaatgaacgataactgcacgccccgcacacaggtcaccgcaaaaaagcaggcccggttaatcccggcgcctgcccgcatcgcatttacatcgttatttctggttaatataattcaccaggcctccggccgtgatgatcttctgcataaattccggaaaagcctgtccctgatagcttgtattcttcgtcttgtttacgatgattccgctgtcgaagtccacttccacctcatccccgttcccgattgccattgccgcttccggacattcaataatcgggaggccgatattgatggcattgcggtaaaaaatcctcgcaaatgtctctgcaatgacacagcttacccctgcacatttgattgccagaggcgcgtgttcacgagatgaaccgcagccaaagttcttattggcgactatgatatcgccttcctttacctttgtaataaattctttgtcaatatcttccatacaatgcttagccagttcttttccatccgtcgcattcaggtatctggccggaataatgacatccgtatccacattatcgccatatttaaacacatgtccacatgccttcatctttcttcctcctcatcaattcccgctgctgtgccgtccggcacagctaaggtcggttcaagcattataatcccagttcacagggacagcttattttgcctgttactgcactggctgccgcaacggcagggcttgccagataaatttccgagtccacatgtcccatacggcccacaaagttacggtttgttgtggaaatacatctctcaccctctgccagaattcccatatagccgcccagacacgggccgcaggtaggcgtgctgacaacagctcccgcctctacaaagatctccatcagcccttctctgatacactggagatagatagcctgagtggccggaatcacgatacagcgcactccctttgccaccttgcgccctttcagaatcccggcggcaattctcatatcatcgatccgtccattcgtacaggaaccgatcacggactggtcaatcctgacctctcctgcttcttcaatggtccttgtattctcgggaagatgcgggaatgcgattgtcggtttcagttcggacaggtcgattgtataaactgcgtcatattccgcatctgcatccgcctcatagattttataatcacgtttggaatgttccttcatatattcttccgtcagttcatcgaccgggaagattccattctttcctccggcctcaatcgccatattgcagattgtaaaccgatcatccatggtcaggtttctgattccgtcgccgcaaaattccatagatttataaagagcgccgtccacgccgatcatgccgataatatgcaaaatcacatccttgccgctgacccatctggaaggttttcccgtaagttcaaatttgatagcggaaggtatcttgaaccaggccttgcccgtcaccatgccggccgccatatccgtgctgcccacgcctgtggagaatgcgcccagagcgccgtatgtacaagtatgggaatccgctccgatcacagcatcccccgccactaccaggcctttctcaggaagcagggcatgttcgattcccatctctcccacatcaaagtaattggtaatatcgtgccggcaggcaaattcacggcagcatttacagttctgagccgatttaatatccttgttcgggataaagtgatccataaccagagctattttctcattattaaaaacggtctggttatccatcttctgcatctcattgatcgcaaccggcgttgtgatatcattgcccagcaccagatccaaatctgcttcaattaactgtccggcttttacctccgaaaggccggcatgtgcagccagaattttctgagtcattgtcattcccatgatttgattccctcctaaaaattatgtatttacattatagcatcggccctgttataatacaaatatataatacgaatatatgttataaacctcggttataggcagactgcaccggcccaatctgtacagcctgcccatggctttcaaacatagttacagttcagccttcggccaaactgcaacaaatgatgcacagaaacggcaaaaacgccgttgattgtggtgaaaagtttacttttcgtcgcgccgagccgcataactcgggattttcgcaaaaaacagcgaaaacacctcgcggaatacatcatggctgaactgttaccaaacatatccagataaggggagtcattatggaacagcatttatcccaatataaaattttctacgcggtagccaaagccggcaatatttccaaagctgccaaagagctttttatcagccagccggcaatcagcaaatccatcagcaagctggaggagaatctgggcgtctcattgtttacaaggaattccagaggggttcagcttaccgtggagggacaggtccttttcagccacgtcagcaatgcattcgatacactggggcggggtgagaacgagctgaaacggatcaagaattttaacatcggccagattaaaatcggagtcagcaatacgctctgcaaatatattctgctcccatacctgaagggctttattgatgaatatccgcatgtcaagattatgattgacagccaggatacggccagaactatctcgatgctggaacagcagaaactggacataggcctgattgcggagccaaagacaagaaggtcgctctcctttatgccggttatgagaattgaggatacctttgtctgtactaaatcctatctcgataatctgaagatccgggagggggaggatgtgaatatcttttctgccggaacggttcttctgcttgacagaaataatatgacgaggactcatatagacgcatattttgcagaacataatatagaaataaagcaggttctggaggccaccacgatggatcttctgatcgaatttgccaaaaccggcctcggagtcggatgtgtcatccgtgaatttgtccgaggggaactggcagacggttccctgattgagattcctctcagttcccctgtaagaagcagaacggtcggatttgcttataatcctgcttatgctactaagacaatgaacaattttatccgcttctgttcatcaaagtgatcgaaaaaggataccgtcccagcagcgctgagccagtatccttttcagatttatttggttatagcttttcaaacagagaacgcacctgcgcctccgtcacgttctcaatttttttccccgccacatattcaaaagcctcctgccattccctgtcgctgtaatggtccggctctatttccgatactgccctcttcacctgctcaaaccggccggagtcatggagatctgatatatacaggcatcccacaattcgtctcaattcgtctaaaatccccttgctcttttccatccacctttacctcgtccaaacaaatagaagttttatttccgtcgtatcacgtttaataccatacacaatctattttatggcattatatgcttcatgtcaatctttactgcgcatataatgcgctaatttttaccagtttatggcataaactatacgtataaaggcggtgcaacttatgtatagcgaatttgactttggaagaagattgtcgcaactgcgcgaaaggaagggagtctcagcgcgtgatatgagcctttccatgggacagaaccccggatatatcaataaagtagagaatggcaaggccatgccgtccatggaagtttttttctatatctgtgaatttctggccatcacaccatctgatttttttgacgaaaagaaaaaagagccctggaagctgcatcagcttacggaagaatgccgttatctgagcagtgaaagtctggaacacatcctggctatcgtgaaagggctggctgaacacaaccgatgaagccgtttaggaaagaatcccgcgagcgggattctccgcctgcagcgggccgctgtggcgacataattccttaccgccgcaggtattggctcacttagctgcttttttcctgttattaaaaatctgtccttctaaatctgcaatcgttatatgcttcagctcttcccggcatttctgatccagctgctgatacaggccgtccagcagcccggccattccggaggcaatcaggcagttcttctccagatttccgcttttccaggaggatgatacaaacgccactcccagcgcatcggcaatcatgcacaagtttaccttggaggcatcggcgctgaactgataccctccgtccagtccctccttcgtcgaaacaaggccggcctttttcaggctcgccagaatcttcctgactctcgccggatttgtgcagacattctccgccaccatctcacttgaaaccaccgtctttttatggtttaaaaatactaaagcatgtacccctactgcaaattcacctgtcatccttctattcctctttcactgtttcataagtccagtcgatgattcctccaaaatcataaacctgcgaatatcccatctttatcagcttgtcggccgcctctttgcttctccggcccgaccggcagtataccagaatcttatcctctttctcactcagcagttccggctctgtatccgctatttcctcattcggaatgttgactgcacccggcacatggccttccttatactcctggagtgttctgacgtcgacaatggtcacatcctcattgtccatcatatccttcgcatccgcggccgtgattttgtgatacgctttgttcttctgcgtttcttcctgcgctgcggcattcgcccgggcacatccggacagtcccatcataatcagaatccctacgcctaataataccttatttttcatgttttttcacctgttttgtaaaattcgtcagttaactggtacctgtgtttctgccgcttcctccgccggtcctgccggccccgcagcctccggctgttccggttcaggagcctgtacgtctccgccctgtgtcccggcagcaccttccgaatctgccgcgcctgccgattctgccgcgcctgcagtctcttctatctgagggaatgtggtattgcgctgaattaccccggccttactcttataataactgttatgcagcggttcttctttcaggacctgcccgtccttggtcaggacacggaagcttttccagacagaaccgttctgtccctgatccactatcttctccgttccaaacggtaattgcgtgttttcttcgtaggacggcgcagtcggttccgcatcccgtaccttctcggaacggatgctgaccttgaccccgtcgtccagaacgggaatccccacaatcgacagtttcagctccagtccgctgaccgtggcccgcagtacaaccggcgcggcgcttgtattaacgaattttaaatccggaccggcatagccgtcaaagctgaccatggcatcctgccccttttcgacataggagggggcaaaactgtgcgcgttccgctccgttgtcttaaatccggcctcaatgatcgagtggtaaagtgtggtggagacctgacagacgccgcctcccggctcctctatcagtacgccgctccggtaggctccggccggctgatatcccttttccttcgttctgttccctgttgtattgttgaaggaaaattcttccccgggctttagaataagcccgtcaatcgcctctgctgcaagggtgacgtttttattacggtttttattattggttaatttcgttgtaaaggttccgattacctgatactgcgcttttgcctgcgcctgggtacgggcgggcggtgtaatggaaaatgacgcttccaccggacttttatagtccccctctctcaccgaccgcataatggacgtcaccagattatcctgatccagattccgcccgttccggtctttggaatattcatatacgcctgtttccttgttataggacactacattggaatccacaggcttttgatcccatttatctgccagtcctgccgcctgttcccggatatcctgctccatccgctcataatcaaaggaaagctttacttcctctgcctgtccgggcgcgctctccagtatgcgcgcaatctccgcctccaccggatttctcagttccaccgtctcatccgggccctgtaccttaatgggacctgaaaatttttccgataaaacctttgccgcttcctctttggaaagtccgctgatatctatgccttccgcaatcactttctgctgcggctttctatctgcaccctctgcgtctgctccggccccgccgctctccggcctctgcagctgcgtctcgccatatacggctgtctgccgcttctggagcagcggcacagcgacggcaatcactgcggctgcggcaataccggccgccccaaaaatgaggagcctgcgcttttggcgggctgcggaattctttctgcgccttgacatattgattcttctttccctgcttcctggtttattatattttcctgtcattttatcatcgtccttttagaatggatttttccgagaatatcatatccattttcttccatctgtattttttcaaattacagtttgtactgttacaatatcagatacagttaaatctgtcaatatctttttttaaaaaatcggaagaaagaactccgctcgagagattctccgcctgcggcgggtcgcttcggcgacttaattccctatcgccgcaggcattggatcacttagcgaatgtaacgaacttagtgaacaagccctctttagagctgcgatcctccgcggagcggtttttatttaacaggagaactttcctgttaagcgataatctgcacactccgcgcacaggtcaccgccttcaataaaaaaagacacccgacagtcatctgaactgccaggtgtcacgcctttacgtattcggtagtgaaatcgttaaccatgctggttttctgtttgccaatcaaatgttctaattcatcggcagataacaatccttttaaataaatctgcacaatttcaacctgaccggagccaatttcagctacaagctctaatttactaatttctctcacctcctgtctctaacatcagcttaataatatcacagcattggccggcctgctttaaatatcagtaaaggaattgtattttttatgtaagtttcgctttcatcacgcattcctgttaaacgataacctgcacgctccgcgcaactgtcaccgtcatcaattaaaaagacggcctccgcaaagaccgtctcatccctgatttaatcatattctgattatcagttatcaattaatttgttcgtatcgttccagctgtaaagcttacgcagttcggttcctgtactctcaagcagatgggccgcttctttctttctcatcgcattgaaatgcgggcagttcacctggttctcaagaagccagttctttgcgaatgtgccgtcctggatatcggtcaggatctgcttcatggccttctttgtctcatctgtgacaatcttaggtcctgttatgtaatcgccgaactcggccgtattggaaatggaatatctcattcctgcaaaaccgctctcataaatcaggtctacaatcagcttcatctcatggatacactcaaaatatgcgctctcaggctcatatcctgcttctaccagagtctcaaatcctgccttcatcagggcagttacgccgccgcagagaactgcctgctcaccgaacaaatctgtctcggtctcctcacggaatgttgtctgtaaaacgcctgctcttgctccgccgatagccaatgcataagccagtgccttgtcatgtgcttttcccgtataatcctgatgaacggcgatcagacatggtacgcctcttccaatctggtattcgcttcttaccgtatggcccggtcccttcggcgcgatcatcgtgacatccacgttctttggaggtacgatctgtccgaaatgaatcgcaaaaccatgagcaaacatcagcatgttgccttcgtccagattcggctccacagactctttatacatctgggcctgcttctcatcgttaatcagcaccatgataatatctgcttttttagctgcttctgccgctgtataaacttcgaatcctgccgcttccgctttagcccaggatctgcttccttcatataagccgatgattacatgacagcctgattcctttgcattaagtgcatgggcatgtccctggcttccgtagccaatcacggcaattgtttttccttctaataatgataaattgcaatcttcctgataataaatctttgccattctttgtactcctccttgggatatgttaaagttgataattttataaagaatgccgccgacgcctctctgtacgcctttggcgacactttgtaactcggttacggaagaaaacggacgtcgtctgcccctctggaaagccccgtaagtccggttctcgccagctccagtatctcataatcctccagaaggttaatcatcgcatccagcttggactggtctcccgtaagcattaccgtaacggattccttgcccacgtctacgattgaggcacggaaaatctcggcgatggcgttaatcgccattctctcgctggcattcgccctcaccttcaccatcataagctcccgatagacggaatgtccctcccggagttccttaatatcgtgaacatcctcaagctttccgagctgcttctggatctgttccagaacctgctgatcccccagagacactaccgtcatcctggaatatctcggatctgccgtgacacctacggtaagactttcaatattatatccgcggcggctgaaaagtcccgctactcggctcaaaacaccggcggtgttatctactaataatgataaaacaattctgctcatctgcattccccacctcgctatgtcatgatgttgggttcaaaaggtcttttgacccctttgataccggattgctccgcactgcgtgctctcacaatcctcaaaaacattcgcaatccgctcatttttctgcgaaaaatggcttctggtatcatgtaatacagttaatgataacaatcaaacctttctttgtcaactaattaaaaggaatgggtagtattacttacagatataccgctcttattccgcaatattttcatgaaattaagttgacagcttctttttgttatgtcatactttaataagtagttttaataaccacatttggaggttcttgattatggaaaataagatgaatgataatagagttccccgtgaaagggtggccatcctgattgattccggatgcgatgtgacagaggaattaatcaggcaatataatatgaagcttctgcgtctgcacgttatctatccggagaaggattattccgacgacttagatatttcaccgcagactgtgtacgagcgttttcccggagagattccgcatacctccaccccaagtccccaggaagtaaaggatatggcagatgagctgaaacgggaaggctacacccatgtgctggcctttgccatttcaagcggcctgagcggaacgtacaataccatgtgcagcgttctgaatgaggaagaggaactgacttcctttgtccttgatacacgcaatatctccttcggttccggggttctggctgtctgggccgcccaaaagctggaggaaggaatgccttatgaagagcttgtccggcttctccccggcaaggtacaggattctaaaatcttatattacatggacacgctgacctatctgcagaaggggggccgaatcggacttgtcacctccatcgtaggcaatatcctgaacctgaaacccatcatctcctgcaacggggaaggcgtttattataccgtcgctaaaatcagaggttccaagcagggtatgacaaagctgttagccgaggcaaaagattttgccggagacggacccgtatggttttccctgttaaacggcaacgctgccgccgcttccaacgagatgcttaagcgtattaccgaagcgctgcctgaaggaaaacatcttctttcaaagcagattgccgcctcccttgccgtacataccggccccggacttctgggaatcgggatcctcaaaaatccgtgatgatttcccttcaaaaataactccattcgaatattgtaaagccgcagcagtctgtcgtttattccttgagccaaataaaccggatgctgcggctttttaattgaaggcggtgacctgtgcgcggagcgtgcaggttatcgttctggctttagccagttgaaggcattttcatttttcgtgttccgaaaaatgaaaatgcctgaaacaggaaaccacctgctttgcgggtggtgtagcaagtgcttatagcaatttactttgaagcaggtttatgcttacaactttattagtatgtgcaatatagcgcttttaaagccagtagtagggcaagagatcgttgccaagtttgtcatgaaagtaatggtatcgagttcaacatagaacatccagtaactttaggtgcactttaaaagcgccttgagacgcagccagtaccagaggcttatagcctcagagcaaaccacccgtttgacgggtggttatgattacagtagattctgctgtatattggtaatatttctccatcccctggaaaaaaattccaaattttagtatacttagtaaatgactgtttttaatccgattttataaagggggggagcggatgcatccaaatcaattattcattgaaaaatcagaaaagattctaaggaccagaccaaagggctgctgctatcttctttatctggacataacagatttccagtatatcaatttctgttatggtactgaagccggagatcgtctgcttaaggcagtgaaagattatactgccggcctgccctttgtgcttctctgtgaaagactgtactcagattattttctctgtatcctgtcttttcccggagaggcgccggatgaaaaagccgtacaggctgtggagcacagcctcaatggttttatggccgaacagcagaagctgtatccggcctgtaaactgagatttgcctgcggactctgccgtaccggtacgcaggaattatcacataccattgaaagcgccaatctggcccgtaaggaggccaaacggctggacaccggctcagccgttctctacagcgaagaactcgtccaaaaaaccgtcacccgttatgagctggagcagacactgaatcaggctgtcagggagcagagattctgtttctatctgcagcccaaagtagatctgaccaatggacggatcatcggtgcggaggcactggcccggaggattggacaggacggcaccgttatataccccgacagtttccttcccgtgatggagtcctccggaactgtggtagagctggatctgcttatctgcaggcaggtctgcgcttttttgtcaggaaggctcagacaaggcctccctgttgtacgcacatccgtcaacctttccaggctgcatattaaaaataaggatacagcctcttctcttcacgcaatcgcgcaggagtaccaaattcctccggagctgctggaatttgaactgaccgaaaccattctgctcgatgaactgaccggtgcaaaaaaactgattgaccagcttcgcacctatggttaccgtgtctcaatcgatgattttggttccgggtacgccggtatcaacatatggcaggagctgaattttgactgcctgaagctggacggatgttttctctccgaagacccagaactgaaaaagaaaaatgaggcccttgtccccaatattatcaatatcggccaccgcctcggtatcagtatcttatgtgaaggagtggaaacggccggacagtgcacttacctgacacgtctcggctgcaccaccgtacagggattttacttttcccatccgatagctccggacgttttttatgacatttaccggaagcagaacggttgttaccctcttcctttccagaataaccacaatacggaccggacggctcatgaatccggtggattgccaaagtccgatgtggatccgtccttaaatccgtccctgaatccgaaatggtatattcctctttccttatgttctctatttatggcggtatgtgtgattctggccaccatattttaccagcatattgcccgggagcagtttaatgaactggtgctggagaatctggattcctgtatgaacggccaaaaagcggagattctttcgggcattgaaagtgtgagttcaacgctccggaacctttccgtgctgatctcccagcgcggtgactcgaaacgggcagaggaattccttcaaccactgaataaaggcgagcccccgggcaaatattcctggatgtccgcagcgaatatagaacaggcagaagaattattccccttaacgcaggaggaccagactgctgcgctccggctgaagaagggagaaaccgtcatatccaatctgattccttcccatcggccggataatttatattattatgccgtggccgttccagtctttgaaaacggtgttttttccggtgcgatttgcggcaccgtcaatgcgcagagcctcaccggcacctcgctctattctacagcccagggctctgttatcggctgctttatcacagacggcaatggaacggttctgccgtccgcaggagaagaagaatatgccacactggccggatgcattgcgaagctgaatatccggccggatgcacattcctctgatatcgccactgttttatcagcgccgtccggaaactggaaacttggcaccagagaccggatccccttctatctgtccagggctgatttaggcattaacgactggcatgttaccgtactttacagggcagataaggccgccgcccgttcaaacaggattaccacggcctctctctgttgtacggcagctttgtttaccgctataatattgatttacctgattattttcctgtatatgaagaaaatccagaagaaattttccatggaggagcagcgctaccttcttctggagcaattctccgatactgtgcttttcgattatgactgccttaaagacacaatccgctttacccctaatgcagacagactgtttaaaatccacgatctagtgcagcacaattacctgcacggcctggatgtcaaatatatctatgccggagacatggaaataattcagtccctgctcatgggccaatccgttcagaaggaaatccggatccggcttcttcatccgactgaagaccgctatttctggtgccttgcccagttccggtatctgtttgaacatggtactctcgtatctgtcgtcggaaaaataacagatattgatgaacagaagctgcatgaagattatctgattgaaatttcggaaaaagacgggctcaccggcctgcgcaacagagcctcagccgaggcaaaaatcagagaaagcatccaaaacggagccgacggcaccctccttatgatcgatgtggataatttcaaacaaatcaacgatcagtttggtcacaccgccggtgacagcgcccttatttttctggccgattgcctgcagaagacgttccgctccaatgatatactgggccgggccggaggggatgagcttatcgcttatatggaaggcgtctgcaacagaaatattgcccaaaagaaggtggaactgctgatgtactacatacgccaaagcaccagccagggtctcccctttatctctgtcagtatcggcattgcgctctgtcctgatgacggtatgtcttatgaagagctgtttaccgctgccgatcaggccatgtacgaagctaagaacagggggaaaatgcaggctcagttttatgaggatatggcatgataatgctaaaaacatgcttttccggcttttcttcaccttaactgaaaaacggggatgcaaacgcatccccattttcaataaccggatttgacatcggccgacggctcagtctttttccgtcacatcgctcctatccggctttcccagtcactaccatatttaaaggccatcttcatctcacttcccacactgataaaaacctcgtcatccggaatctcctccctgcggtaccagccggcctccgacagctcatcctcctcaagccgaatcgtatcgtctccgtccagttcggcaaaaaagcctatcatctccgtatcggtaaatgcccatggctgacttttgaaatagcggatattccgaaccttaagtcctacttcctccattacttccctctgcaccgtctcttcaaaggtctccccaatctctacaaaaccggctatcagggcgtagcctctatagggcctgtcgcggtatcttgacattaagagcttatctccgttcgtgaccgccacgataacggccggtgaaattttgggatactcaatctgtccgcagaccggacagacgagggcgcgttccgttgtactatccgttgtgcccgcaccgcagcggccgcagaatttcctgctctcccgccatctccatatctgggtcgccgtgatagcggcaaacgcctgatacattggttccatcagtctgaaatactgtgtccctttaaaggcaaaacgaccggtttctgccaccgcattctcttccttattctctataaggaaataagatttttcatcaattgcaaacagatagaccgcccgttccacggcatcggcaaccacctccgtaatttcagaaaacaggggaatctcatagaccgcttccggtttctgcgcttcccgtctccgggcagccgtagtctgttctctgtcaatcagcagagtccggttattatgtatcaccaaaacataatccgcagcctccggcctcctcgtcttaaaggcgttgtcgtatctgtgtggggcaatatcctgaatcatagcgtgttccatccttttcgtaaattctataccatctttcgattgaattattatattgctttttttcgatacttgcaatggtattgatgaaaattacgccgccggattcactataggttactgttacaccatgccaaaaagaggcaggctgtaaacaataacacctcgcggaatacaacctgtgaacagtaacctctatagttctgatctcaacttcttcaacaatttttttatctcttcttccccggctgaagaatacagctttccgtccagcagaaaattcggggctgtcctgcattgcttcaggcagtccctggtctccagcaggactttcttatccgaagaaagggcgccggaagccgggatcttccctttaatcccaagttctttttttactgtgtccaggagattttggccttccctgtgacagttttttccggtgcagaacgtcatcctgtgccggtagggagccggtttaaggctcttgtaaagtttcatgatacagtcaataacagacagcttgactcctgccgcttcagccgccatttccttatgttcagcagaaatccagccgtaaagctcctgtatttcctgcatcatagacacaatattctcttgtgatgagggtgaagtcatgctgctgtaataactcagtatttctttcagctcttcctcccgtctttcctgatccgttcctgcctccatttcccgctcggctcctgtctttccacgcttatcctgttttttcatgctgcttcctctctcctgcttacactttttaaaatagtatggacacagtaaggaagttttatccttttagcagataatcatgtaccaaaatccgaactgatattaccgcacttctgcttatgacagccggcctttaaaatcttcataaccaaattctttcaccggccggaaccttccctgtaaatccctgagtacgagagacggcaaaggcattccgttaaacgtgttatttttgaccatggtataaagcgccatatcagaaaatatcaccttttttccttccgtcagcggcgtgtcgaaggagtagtcgccaatgacatcaccggccaggcaggtcgggccgcccagacggtatgtgtgcggcttttctcccggctccccgcccccaagcaccggcggcctgtagggcatctccagcacatccggcatatggcaggctgccgacgtatcaagtaccgctatctctattccgttttccattgtttcaagaaccgtggagacgagaaaaccggcattcaggaccacagcctcccccggctccagatatatttccaggccgtacctttccctgagtttcaatatcaggcgtatcagcctctcccggtcataatcttccctggtgatatgatggccccctcccaggttaagccatttaaggcgcggcagatagtttccgaacttttcctccagcgccgcaagcgtcgtctcgagggcatcggaattctgctcacagagcgtgtgaaaatgaaatccatccagatacggtaaaagttccgtttcaaacttccctgcgctctccaggttccgctttgtcgtccccagtctggagccgggagaacagggatcgtaaatcgcatggccttcctgtgtggagcattcggggttcagacgcagcccggccgactttcccgccgctttgacccgttccccgtatttcttcacctgggacggcgaattgaagacaacgtgatctgcatatctgagtatctcatcgaattcgtcttccctgtaagcggccgaaaagacatgggtctccccgccgaattcctcatgccccagtctggcctcgaaaagtccgctggctgcacttcccgccagatattcccggagaaggggatagacggagaacatggaaaatgccttctgggccagcaggatcttacatccggccctcccggaaacctccctgagaatctccaggttctgttttaacagtgtttcatccaccagataatatggggttttcagcaatccatcccagtattccatcgatccttctcctttattttccagtattctttttcatcatttattaatccaccagcgccggctcaaaggactccttccatggaaggccccatttattcagcgcatccatgaacggatccggatcgaattcttcgatattccagacaccgggtttcttccaggtaccgttcataaccagcattgcccctatcatggccggaacgccggtggtataggaaattgcctgggaacctacttctttatagcattcctgatgatcacagatattgtacaggtaatacttcttctctttgccgtcctttttcccctggaaaatgcagccgatattcgtcttgcccaccgtgcgcggcccgagcgaagccggatcggggagaaccgcctttaaaaactggagcggcacaatctcccggccctcgtacataatcggtttgattgatgtcatccccacattttccagacatttgagatgggtcagatagctctggccaaaggtcatgaagaagcggatgcgtttgattcccggcatgttcagggccagtgattcaatctcctcatggtggagcagatacatatccttctttccgactccctcaaaatcgtactctctctttatctccatcggctccgtctccacccagcggccgtcttcccagtaggagcctttggcagatacctcacggatattgatttccggattaaagtttgtggcaaagggatagccgtgatcgcctccgttgcagtccaggatatcgatatagttaatctcatcaaattcatgcttcagcgcataggctgagaatacgccggtcacgcccggatcaaagccgcttccaagaagggccgtaatacctgccttttcaaatttttcacgatactcccactgccatttatattcaaatttcgccgtgtcctccggctcatagttggccgtatcgatataatgggtcttcgtcgccaggcaggcgtccataatcgttaaatcctgatacggcagcgccagattcagcaccacatccggtttatacgcttcaatcagggcaaccaactccccgacattgtccgcattcacctgagccgtctcgattttcgttctggtggagccttccagcttctcttttaacgcgtcacactttgattttgtacggctggcaatgcagatcccctcaaatatttcgctgttctggcagcatttgtgaattgccacggatgcaacgcccccgcagccgataattaacgcttttcccatgctttattcctccttgcatttctctgctttacttattgttctgtattatttaatgattcgtttaataccctgctttattgcccgatttatttattgcctgctttatttattgcccggttttatactatccgacagtgcgatcagcatctccctgacaatcttgcaggccacggccgtggatgcaccggatacgtccagcatcggagccagttcattgacatcacagccggctatctttgcattcttgcagaccagcgtcacggcgctgcgaagctcgtcaaaactcacgccgcccggttccggcgttcccgtacccggaaagactgaggtgtccagcacatccaggtcaacggtcagatagaccggctttccctgcagtgcccggagcgcctccataagactctcctgcgccagattaaagcggtgggtatatacgtgttcccgcccccagctccactcctccctgtctccggagcggatgccgaactgatatatgcggccgtcgcccaaaagctcatggcaccttcggatcacgcaggcatgggacagcttcgcacccaggtaatcatccctcagatcggcgtgggcatcgaaatgtatgatatggagatccggatatttctccctcacggccctgacggccgccagagttaccagatgctccccgccaatcataaacggcacttttccatcttttactatctctcccgccctcatttccaggtcggacagggctgcctccgcactgccgaagcacagctccaaatctccgctgtcaaatacggcgcagtcaagcaggtctttatcctggtatggggaatagctctccagaccgtaagactccgagcgcaccgccctggaaccgaacctggctccgggccggtaggaggtggtggaatcaaacggtgcgccgtataaaacgatatccgcctcctcatacggtgcgtcacaagccagaaaattctcaatatttgccttcaacatcttctaacatctcctctacgtaagcgggcaggtaaaatgcgcccttatgaagtgtggtggtatagtatcggcagcataagccccgcatgttccacctggtttcattcaaatccttaagcggatggtatttctttgatgcaaacccaaacagccagtgtcccgacggataagtcggaatatgggcctgatagacgcggctgatggggaaggattccacgatccgcttatgcgccctcttgcaggcctccgcatcggcgtcataaaacgggctttcatgctggttgaccatgattccgtcttctttcagagccttatagcagttaccgtaaaattccctggtaaacagtccctcccccggtccgaagggatcggtggagtccacaataatcaaatcgtactgattctcacaggagcggacaaatttcaggccgtcttcgtagtggatggtgagcctctcgtcatccaggcggcaggctgtcttcggcagatattttctgcacacctccaccaccaggggatcgatttccaccatgtcaatgtgttctatctcatggtaacgggtcagttcccggattactcctccgtcccccgcgccaatcaccagcacctgttttaccgccggatggacagccagaggcacgtgtgtgatcatctcgtgatagataaattcatccttttccgtcagcatcatataaccgtccagcgtcagaaaccgtccaaattccggggaatcaaagacgtcaatccgctggaattcactcttgccgctgtagagctggcggtctacccggatggacagctttacccccggcgtgtgtttttcagaaaaccagaaattcatgttatactcctttcagtagagatttagttaagcaggtgaggacgccgccggaacggccggcggacggggtggcggagtgtgtatatgagtctttcgtcccgggggaggattgttgtggtttggggctgcgggcgaagataaagtctgcggagcacgctcccgctctgtgaaatgcatcgcgctgctaagctcgtaagggacctcgctaatcagcgatggatttaggcggcatccgcagactttatcttcccctccgccccaaggccaggttttcgccgggtcgaaagactccgccgggtgtaccggccccgtccactggcctgcggccgctgatagtctcacgcgttaagtgcgggggcggaccttgtcgcggccactcagtgcttccgtgtgctggaaatacgatatgccttcaaggcgcccttatgaaagaattgcggaagtttgatatcggcctgccagaaacacgtagtggcgcgacagggccctccccatttaaggttggagacaatcagcgaccggagcggaccatgtccggtgtgcgaaaacctccgcctgagtcttccgtccccggcaaaaacctgaacgggggaagtaggcggaatcaattctgcaggggatatggaagcccatccgtgcttaatgaggtttctcacgaatttagcacggctatgcgcttcgaaaagtgcaaacggtccccgtaagaattcattcctgccggattcccccctcacgacaacctccaaccggggacggaagactcagccagtccccctccccacaccggacatagcccgttccggacgcgtcctccaaacctcagttaaatctccaatacattcaacctctcaattgcggcatcctccggccctgtcatcgaacatcccttatcctttgcatagcgtatgtagtcgataatctctgccgtgatccgttctcccggtgtcaggatcggaattccgggcggatagcacatgacgaattcactgcaaatgcgtccggccgtctcgccgatgggcagggattctttttccgcgtagaatgcctcctggggcgacaggactaccaccggatcgatataatcataatccatcaggctggatttatctcggctgaaccggcgccgtatctccgagagggcgcttacgagccgttccacctccctctgtctgtctccgatagaaaggtaggcgaggatatttcctagatcgccgaattcaatctggatatcgtactcatccctcagcagatcataaacctcgattcccgccaggccgatatccctcgtatggacagagagcttcgtcacatcgaaatcaaagatgctgtctccattgaccagttccctgctgtatgcgtaataaccgccgattttattaatctcattcctggcgtacccggccagctccgtcaccttcccaaacgcctcttttcccctgagggccagattccttctggaaatatccagactggacaaaagaaggtaggagccgctggtggtctgggtcaggttgataatctgtctcacatagcctgtggacatcgccgggcctgtaagcaggagggaactctgggtcaggctcccacccgatttatgcatcgatatggctgccatatcggctcctgccgccattgcggagacgggcagtccctccccgaaatagaagtgggttccgtgtgcctcgtctgccagacagagcatcccatgctcatgcgccagcccggcaatggagcgtaagtcggaacagattccatagtaagtcggattatttacaaagacggcctttgcatccggattttcctcgatggccttcttcacatcctcaagcctcataccaaggggtatgccaagcctcttgtcaccggccggattgacatagaccggaacggctccgcagagaaccagcgcccccataatgctgcggtgggcattcctgggaagaatgattttctccccccgcttcacggctgccagcaccatgctctgcaccgccgaggtcgtacctcccaccatcaaaaacgcatgggctgcgccgaacgcctccgctgccagacgttccgcatccgcgataaccgacaccggatggcacaggttatcgagaggcttcatggagttgacatccatctgcatacacgtctccccgagaagagacgtcagctccggattccccctccctctcttatggcccggcacatcgaagggaaccaccctcattttctgaaatttctccagcgcctcgtagatgggcgccctttcctgggtaagtccggtcatagtaatcacctccctgattagtatatattgcgtccgctgaaaatctcgatcatttcccttctcaggctgtccataatggaaagcctcgtcttgggcggaagctcatagacatccgttttgaacagatagttctgcaaatcaatatccttcaccatcattttcgtatggaaaaggttggcctcatacacattgatatccaccacgtcataccggcgcagcgtctcctctgcgatataatcctgaatggatttgacccggtgatccataaaaagctttttgccgtccatggccctcgtaaatcccctgacacggtaatccattgttatgatatccgaatcaaaggaaccgatcagatagtccagggtggacagtggggtaatctcgccgcaggtagccacgtcgatatcgacacggaacgtggcaaggcaggtctccggatggtattccggataagtgtggaccgtcacatggctcttatctaaatgggccacctttgtctccccggccaccgggaccatggagccctccgcgatcaacagcgtcacggacgccccctgcggctcataatcctgctgggaaatgttaaggacggtggcgcctatcatatcagtcagcgtcgtaaggattccggtaagccggtccgaattatactgctcgtcgatataggcaatataatccttctgctctctgggcgttttggcataacagacgtcgtaaatattaaaactgagggcttttgtcaggttattaaacccgtataatttcaacttctgatccatcgtatctccttttccaacggtacaatgcaaaaagcggtaacagttcagccatgatgtattccgcgaggtgttttcgctgctttttgcgaaaatcccgagttaagcggcgcgacgcgatgaaaagtaaacttttcaccacaatcaacggcgtttttgccgtttccgtgcatcatttgctgcagtttggccgaaggctgaactgtaacaaaaagcgcaagtgatgtgtctgcatcacttgcgcaaaaataatccgatcgttctattctcctgcatccaacggataaacctcccgccggaaattctgttaccgcccttcccgggcgttatcacgaattaaggaaaactttgattttcagagtctatatagcaaatattttacttttaccactcttattgaccgtttcacaagttgatgtgcaccatcgcactggttgtaaagtaaccaacttataaaatttgagcttctaactcaatcaataaggcaacgaaagttgccgctcggcatttgacccggctgtccgtatggcctctacccgtctgcggcgggtggtcaagaatatttgcatggatgactcatctaaaaatcatcatttttccatgtcgcgagtatcatatcatttttagggtggtaaagtcaagaaaaatgtggaaaatttcttgaaaaggggtaacagtttggagatttagttaagcagatgaggacgccgccggaacggccagcggacggggtggtgggatggatatatgagtctttcgtcccgggggagtggcatcgctggctggagaaggagataccgtggttttgttttctctgggcggagccggagagaatgatatccggctggactgctttttcgagggatagctctaagacagagaaagacaaagcataccggggttccggacaaattcgccccgaactccggatgagttcgaagctcagttgtcccggattttgcccttgaagggccaaaatccgcccggcgcgctttgcctttctctgcctaagagctatcgactctcgggcgaacgtccttccggatatcattctctcctactccgccggaagatgtcgatagtatctccttctcccggaaggttatcgccgggacgaaaaactccgcccagggtatcggccccgtcccctggcctgcggctgctgattgtctcacgctttaagtgggggagaggcccttatcgcggccactcagtgattccgtgtgcgggaaatacgatatggcttcaatattcctttattaaagaattgctggaagattccacatccgcctgtcgggaacgtatagcggccgcgacagggccctccccatttaaggttggagacaatcagcgcccggaacggaccatgtccggtgtcaaaaacctccgcctgagtgttccgtccccggcgataacctgaccaggggaaggaggcggaatcaattctgcaggggatatggaagcccatccgtgcttaatgaggtttctcacgaatttagcacggctatgcgcttcgaaaagtgcaaacggtccccgtaagaattcattccggccggattccccactcacgacaccctccaaccggggacggaagactcagccatccccctcaccacaccggacatggtccgtgccggacgcgtcctccaacctcagttaaatctccatatgctttagtaacagagacctgtctgaactgttaaaacagttcacctgcctatttgacgagtccgataccaacctgcatcacccctgccagcagcatcacagttatcgggttcatatgtctccaacgaagcagataaactgaaacagcgaatatcacaacggcctgcaccttcagattctggagcgccatcacgccctgctctccgaaaaaggccgtgattatgatggacaggcctgccgccccgatcagggagactacggccgggcggagtgagttaaggactccctgcagaagcgtcatcttcctgtatttcatgtaaatccaggcaatcgccgatacgataatgcaggagggcaggatgcagccgaaggtggcgcagagagcgccggaaaagccggcaatcttcagtcctacgaaggtggccgaattaattgcaatcggccctggcgtcatctgggaaatcgtgaccagatcggtgaactcaccaagcgaaagccagtggtgcagatccaccacctgcgcctgtatcaaaggcatggccgcatagccgccgccaaagctgaatgcaccgatttgaaggaagctcaaaaaaagctgaagataaatcatgatgtcttacctcccctctgggccagtagcgtcctgacggcgccgaggacaccgcaggccagtataatataaacggcgctgatattcagaaaatagacggcaatgaatgacagaaccataatcagaatggaaatatatttttttccccgtacgattccctcccccatatcatagacgactgacgcgatgacagctccaacgccggcctgcattccctctaacatcatggcaatgtaaagattctcccggaatgccgtatagaacagggatacgatagagagaatgacaaaaggcggagtcactgtacccagaatggacaccagaagcccgggaacgccggccagcttatacccaatgacaatcgctccatttacggcaatcggccccggagcggattgggcgatagctaccagatccagcatctcctcctcatcaatccagtgatattcatccacgaatttctttttcatcagcgtgataatcacatatcctccaccgaaagtaaatgcgctcagataaagcgtggaaataaacagcttccatattactttccctcgttccattcagttctcctcctctttcactgcgccgcagacactttttgcttgcgtgtacagtaacttctgtacctcatttgcttgcattataaccgctcttgatctatttgtaaaatactattattatataatatagataattaattcattatgtattttcatatttcaaacgagaaaggacaggattatgacacttcgccacatccgtattttcgtcaccgtatatcaatgcgaaagtattacgaaagccgctgaaaaactgcatctggcccagccctccgtcagccttgccatcagtgaactggaagaatactatggactccgtctgttcgatcggatgtcgcgccggatttacgtaacggaagcaggccagcagttttatcactatgctcttcatatctcttctcttttcgatgaaatggaaaaaggaatgaaaaaatccggctccacgggaacattgaaaatcggcgcgggcatcacgatcggaacgagccttctccccgaacttttaatccgcttccgtcagaagcacccggatttcaaaatttcggcattgataaaaaactattccgccattgaagaggcccttctttccaatgagatcgactttgcgctgatagaaggctctccttcctcgtctcagtttatcgagataccttttatgaaagaccgcctctgtcttgtctgcggcgcgtcacatccccttgctctgaaaaaatatgctctcccaggcgaactgttctcctacgattttctgatgcgcgagaccggaagtgcaaccagtgaaatcgtaaaaagtctctgttcccttcacggcctgaaaatcaccccggcctgggagagcgccagcaatgaagcaatcatcgaagcgctcaaaaaaaacctggggattacaatcctccccaggctcattgtccggaacgctttaacagaaggaaccctgaaagaggttgtcctgaaagatatcaatctggaacgctgtttttcagttatctaccataaaaataaatatcttccggagctggcccggtcattcatcgaattctgtgttatgcagtacagctcttcttaatgcctgcagccttctgaatgtttcaatgcatttttatgcttcgccgctcgtttcttcgccgcctttattcagcttcggacttgcaataaacaacgccactccggctataaaaataaagatggaaataaactgggatgtggagaatgtccccacggagccgcggattaaatctcctctgaaatattcaagcacaaaccgccccgcactgtagcaaatcagatacagcgccgatacctggccgggtgcttttgctctcctggcaaaccaaagaagcacaatacagtgcaggaaattcagtccgcttgatataagctgggtcggaagcagcggcactccgttcggcgcgaacgctgaatttgtaaacacgatggatatcgggctgtccacctggagtccgtagcagcagccggccagataacagccaatccggccaagtccctgagccagggcaactgacggcataaccagatcaaagtacttaaaaaacggtaccttgtgtacacgggtaaacagaaatccgccgaatataccgccgataatcccgccgtaaacaacaaagccgtctcccaggtccaaaagcagtttcggattcgcgataatatcgtcaaaaattgtaacataatacaaaagctttgcgcagatcagcccggcaatgattgtccagccggcaagggaaataatcttatcgctgtcgagtccctgtttgctcgccctgtactccgtcataaaatatgcggccacaaagccgagtcctatcataaggccatatccatgtatcgtaaagccgccgattgtaagcaagtcgttcttcatgttgtcctccgttctgtgttgatgtatcggtgtttagtatatcttcttttctgccatcctgcaatggatatgcgtattttttcagagaaagtttataattttgtaaagccgccgggacgcggccgggacggaagactccctacatcaactaaaccaaccctttcatcagctgcggcatctcctcccgctcgaactcacggatggaaatagcctttttattcggattggcaaagacaaacgttttatttacattctccacgtagttctggattttatcattggtagcgctgatgatggcctggaagcccagatcccggatcagctggatacagcttgccaccttttccgcatccattttagagaaggcctcgtctaaaaccacaagccggatggtagggctccgtctcagttttggcggcagcccgatccggtacgcctgggcaaagctggctaaaagcgcgacatagagaggattctgcccctcgcctcctgaattcttttttatcattttgctcagctgcagcttcatgattccatcgtcatttttaataatctgctgcatgtcaaaggagagataggtacggtaatcggcatatttatccatattcctgcgggcctcttccatctcctccgccgaagcgttctccggcgggatgaagatattaatcagttcattaatctgctcaccatactggttctcatgctccattgtaaagaaattcatctggttttcaaaggtctggctgagtttagacggatttacctccagcgcttcatccataaacatgtcgtaaaaacggccgtcggctcccctgtttctgccgatgacaaactgatatttgtcctttccgaaattcaggctgctgataatccggttcagttcatcctttcgctgaaccgcctcgcggatggcgctgcggattttatacataaagtcgtctttaaaatgctccaccgccgtcttggcctgttctgccgccgcttccctgtaatgctcaaggttatcgcagctcagcgtatcgagcagcttgtcgtatgccgcattatcctttgcgctgggtgaaaagctcctgttcggataacgtttcaggtattcaagccggcggccgagcagctgttcaaacgcgcggtcccttgcttccgccgccgctgccgccctgcctttgaaataatcccccagtttgtcaagcctcggattttcacgtttggaaagaaattcgtctaaccggtcctccagctcctgcacctttgtgaagctgcgctcccggtcggaaagctctccctgctgccatacggcctcttttttatatctctcgagttcatcccggctgcggtctatctgtctgcctgtctcgcggatctcctcctctttggcaaagcgcagggcctcgaccgcctcccgctctttctcccactcatcgatattctgttccttgagtttgagaagcttatcttccagccgctttttctccctggtcttctcctttacctgcctgatatcgaggagccattcaagataagtgtccgcactgctttccagcttctcaagccccaggagccggatgcattccttttgaagctcctcctgcggttttttctgtgcacggcactgttctatctcttcttccagcaggcggattcttttcttcacgctcgcctttccgatataagcccatttcgtataatgatccggattgatatactgcaggcggtaattgcggtaaagcatgcagtccggcgtaattcccgtcctgtttttccgaagttcctctatgccgcggcacttgatcaccttccccagcagcatatcaatgaagggccgaaggtaatcctcccgcacctccacctcctttgacaaggcattttcaaatataggcggagcggcttttgacgctttttccgtatccaggacagctacattccaatactccctgcggtccagctccccgtaaatctccattgccgtctttgcataagccggtgcaacgaccagagacagcttgctgcccgccagatagccttctacggcatttctccactcatcgttcctgatatcaagaaggtcggacaggacatggacctccaccgatcttttgcactcttccagaagccgccgtttaatatatgcccgtgcattctccaggtttttcggatatgccttgtttccggcctttaactggctaagctcctcacaggcctgtttttcccgctttgacagctcacggaggattgaaccggcctcctgtttctgtcttcccacatcctcccgcatctcctccacggatgccttcagccggataagcgcctccctgccgatggtacgggcctcaaattcctctatatcccagatggtctggttggatgtgacatcctcatcgacccacgccttcagcccttccgccgtcctctgccatttgtccgcgctttttgaaagatgttccagcagttcattgagattgaggagtttatccttcagctcatcgtatccggtggacgcaatctgccggagcagctcgtcgctccttaatttcagctgtgcagcctgactcaccacctgtttttccaatacttcctgtttatccagatcggaggccgcctgtccgatacggtcggatatctcggacacctgaagacgaagattcattatttccatcttattcatgaaataggtattcgcccgaatctgctcctcctgggcctgtacctcacggtattgtgcggccagctctttgagttcctctatttcccggcaggtatcttctattttctgtctcattctgccgtactgcatcacgctttcctgcatatcctcaatatggatatcctgctccatgcagatgtattcttttacaaaatcctccagtttgatattcatcctgaatggtatcgccctcttaaaaagcagggggaatttttcctgatcaaggccgcccagatatacatcgtagagcagcctgcggaaccgctcattatgggaggtataaaaacactcttcttttccataggaacgcagcagctcctcctccacctccgcgatggtcatggcgcgcccctctgtcctgtagttgttctcccacagaggccctttatgccagaaaaactttctcgagatttcattggaagccgtctccacgtcaaatacaattccgacacactggcattcctccgtgttcgtctgtttcagctccaaaacgatggtcgtagagaaatttctgtttctcagataggcaaattcattattttcccctatgttcaccatgcctctcagatactcaatcaggctgcggtcggaatcatccgcggccgctttattgaaaaagcctcttccgtccgtgttggcatacagaactatctgcatcgcatcaatcacagtcgattttccgctgccggagtgcccggtgaaaaagttgatttcttcgctgaaggaaagagtcttccggctgatataatgccagttattcaggcagatgcgggaaagtgccacaaagcgctccctgtcagtcttcgtctgttgtatcatcatcgtcctcctcaatctccggttccaaagcggaattaatctcccgctgcggcgtccctgcctgcagggcctcgtcctccctgaatgattccagcagttccctgacatcgtcccccagcagcaccacattgatacagggataaacgatcaggcggctgttcccgttcaggtcgtccagaagctcaagcggttcgatcacctgatattttttcagaagagtcaccgctctcctgatatcggtcggcgacggctgtttcttaaaaagccggtagcttccgagcttttcatgcatctcgccaagcgtcgtatacacattgacgctggttgatacgctttccatctgttcatcataaatcagcttcagtatcagaagatacagggtggcaagcctgggcagcttatcccccacaagcgtctctccctgaatataaatgacaccaagctggctgttctcataaaccgatatgccgctgatggaaaaataagtgcgtataaactccaggtgtttattgcagatacggaattcccggttatactggaaccgtccggtccgtctgtcatatttccgctcgagaataaaggtctgacggagcaaaaggcggattgagtctgtaatctccctctgttcttctcccatcagaccgtcaaaatatggaatatctgtcattcgttcctccttacaaataccagcttcggatagcggtatctgccgttatctatcatttccgcctcttcctcctccacaaggtaccggcttttctgtctcgtggaatagtcataggcaaggatcagtttctcaaattcctcatcacaggatacggtgtccgcatctgcctccattttccccgatacggctctctgcgtgataaaattctctatatcgctgcggctgtaacggttcttcacccggttcaagttgagaatttcctctgtggtcagctccttatcctcctcgtccggctccagattctttgagaaatcggcctttacctttctgcgcttgtatagggatgcctccgacaggatattcatctgggacagattcatccgttttcctgtctccgtgagcatgttctcctgctccccgtcatccgccaggcggttcagcagtctgataatcagcccctttgtattgtcctcctggttcagaaggtaattcaaccgcgtcaccgtggcgcggacatacctggaatgctctttgtccatattggaaatcctgtgttcaatatcatcaaaaccgcgttcaatctggcttagcttttcaaggatatcctccatcatccgcgtctcggcggccttctgttcttcctctgccgtcctgccggcggataacaggccgtatgaatctacggcgctctttctgacaagagcctccagccactgctcatcatccctcatctccccgatccagtgcttaatatcggttttatagagatagaaattatcggatgtcttcaaaatatggtacttcttcctgacaatttcttccacataaccttccaggtgatctttcagaagatttgcatagtttttctgctgcagcaggccggcaaaaaatttatccatattgtgcagcatgtcctgaagcgtcttattcagctttttcgtgttgaccagcgccgtgccgagaaggctcagcccggctcttctgtcatttttcagggaaaacagaattgcatagatattctgaatatagatctgggtttcgtcttcctcatcgctgtggagtctgcgaaacgcttccagcatgacagccgcatagtcgggtatgactatattggccgtcatggatgcgtaatcatcgactttcctgagccatccggcccgcaaaagccatcccagcaccctggttgccggaggttccagcgtatccagctcgtcctccagttcatcctgccagataacgtattttttccgggcaaaatgctctcccagaatccggatgcacgcctccctgcttaaaaaataattgctgtattcgtattcttcattgatttttagtaatgcttctatatagacgggccggttaacggagcggaataagctccaaaaccggtccggtatttcattcatcagtctcatcctttgcctccacggcccttctgaaaagcgcctgaccgttttttctacccatccaatgatttaagcgctgaaataagcatggtcagatccagcggctttacaagatatccgttcattcctgcatctaatgcttccatcctgtcctcatcaaaagcattggccgtcatagccagaatcggtaccgtacgggcatcgcttctatccatggctcgaatggctctggtggcctctaaaccgttcatctcaggcattctgatatccataagaacagcaaagaagctgccctcaggagatacttcaaaggtatgcaccgcggcccgtccgtccttcgccgtcacaatgcagagtccatgcatttccagcagcgatttggcaatttccatattcagctcgttatcttccaccaaaagaacctttttccccaggaaagcgctctctacggcctgctgtttcagctcaacactgtttctgcctctgaatttcgtaaacgtctcatagactgaagcgcgaaacagcggtttggaaataaagtagtcagcgccggcagccctggcctccgcctcaatactgctccagtcataggctgaaataataataatcatcgtatccgggcctgtgagctgcctgatacggcgtaccgtctcaatcccgtccatctccggcattctccagtcaatcatcgccacgtcaaacagccagccttcttccagcgctttctttacttccgctacagctttgatgccggaattgacaaaaacagttcctgccccgattccttcgagaatcccggctgcctgctctcctatgtactcgtcgtcatctgcaataagaaccttcatattattcagcagctgactggtcttacgttctttttcccgctctccgtcatcactgagcagcccgaacggcagccggaccgtaaaacggctcccatgtcctttcctgctctcggcttttatgtcaccgcccatcaggttgacaagattgtatacaatagacaatcccagcccgcttccaatcttattccttgcactgtccagcgtctcctgctcaaacggctggtaaagcttctccagaaattcaggtgtcatgccgattcccgtatcactgacagagattttaaaaatggcaaacccgttaatccgtttttcttcctctatctcggttcgtatctttcctccgggagctgtgaatttcactgcattggaaagaagattcatcaatatctgcttcagcctcagggaatcaccgatgtaacagcgttccagcggatccttatgatggatctcgtagtcaattccgcgttccagggattgagggaatataatcgaattcaattcggcaatcatttcaataaaatcaaagggctcattggtaagagtcatcttccctgtctctatcttggacatatccaggatatcgttgatcagggacagcagatatctggatgaggtatcgattttgtcaaagcagtccctgacacggaccgggtcttccattttcagtttaccaatcgtactcattccaattattgcattcatcggagttctgatatcgtggctcattctggaaaggaagtcggacttggcgctgttagctgcttttgccgccgccagggcgtctctaagaagctgttcctgcttcgccatctccgccctctgggcatccagtacctttatcattcgtatggcaatcatatcgccatcaaccggattatcaacgtagataagatgggatgaaatccagtgatactcttcatccatccctttctgcctgtattccaggtaaatctcccgttccccttcggcaaacttcttcattatcgtttctctggaaaacaggctggaatagtcttcgcggtaagcggaatagactctttcggcaccgtaccggaacaattcatcatagcttccgctgcggtcgatcgtataagagtcctgctcttccacaaaacactcatagtaatcctgggtcagattaattctcataatcagcggataggccgtacagatagcggcccggagggactgattctcgatcagtctctgccgttcgctctcaatttcgattcgccgcacttccgtgatatcggtaaatactgcctgtatgacttcctctccgtccgcattcacaatccttcccatcgttacattgacccagacgggtttaccatccttcttttggctctccctcgtataggatgctacatcgccccacaaagtcagggattccgcagtctttaacacccagtccatatcttttccgagtaccatctgaaacggagttatgacctcgctgcggtactctgcttccgatacgaagccataaaattcccatgccatccggttgacactcacgagcctgtgattgggatccgtcgtaaactgaagaatgccgcagggaaccgtattgtaaagctgggtcagaaacttcgcagtccgttccacctctcttcccgctttctcaatcttcagttcattctgtttcttttccgtaatgtctgtgataaaactgtataaaatttcttcgttctggaacagaactttcttaccgacatcggctacccagataatgctcccattcttccttatggcgcggtattccaggtaataggactcgccgctcgccagttcgtctccggttacccgccttacactttcaaaatcttcaggcaaaatgaagttcttacagcaattcccggttctgtccgcatattccgtctgactgctgtagcccaggagctggcacaggctcggactgatccatctggtggtatataattcatcatttttgcagatctgcatgccgccgggcagctgtgacagcatcagttcaatctgctgctctctctggcccagcatttcctggagctgttcgtaggaagccttcgcagctctcaccggaaacaattcatcatcctttacatcgtcgtaggatacggaatgatgaagatgggccagccgaagttcgccgttctccctccggtaaatgaaggtagccctctggtgcgccttcatatacagcccggagccttccaccgattccgcccatcccgtactctcgcaaaaatagcagttctccgccacttccctcacggtgtaggtctcatcatataattcacagggaatcatatcatcctttcccgcacgaaatgcctccgccacagcatccttcccttcggccctcatcatctcgccggccccaatccacacaatatcctgtgtaaatttggagatcaggtattccatatctgattcacaaaaatatctatgcagcaattctttcgataaatcccttacttctctcaggatctcttctctcatatgattccccttttcaatgaacagcagcgggccggtttccggcacctgccacgccctgttttacatcttttccatcaaacccagcccgtctgatatactcatccgcatatttttatctaatgttaaattataacagaattcatttctcaggtaaaggtgttatgctccgtaagttttgactggctttttgtaattgaggttagggggctggctgagtattgacattattccacttgttgaataaaataaaagtataatatataatggaggtatgccaatgtcattaaaacatggtttactcggtcttttgaattacgggaatatgacgggatatgatatcgacagaacattcaaagattctctttttctattctggcaggcgcagacaagccaaatttaccgggagttaaacacaatggaaaagctgggatggcttacatcggaaattgtaatacagacagataagccaaacaaaaagctctattctatcaccggcgcaggcaaacaggaactgagcaactggcttaatgaaaatagtttagacaatgaatttcgatcacgcagcacttttttaatgaaactcttcttttcaggagagagaagcatttcggaaaatatcgcgatgctgaaggactataaagccagatgcctgaatgaactggaggaactggataaagcaatgggcaatatagaacggtacaggcagatcgcagaggtaaatcaggattctgtatactggcagctcaccgcccgttttggaacactgcatatcaaagcctgccatgacttcgcagaagaggcgattaaaatcttggagggtttacaatgaacatcctcgtaataaatggcagtccaaaatcaaaaaacagcaatacctatcaaattacggccacatttttagacgggatgaattccgtccggaatcattcggttgaattaatcgacattagccaatccatgatagaacactgcctcggctgctatgcctgttggacgaaaacacccggacagtgccttatccgcgatgacatggcaggacatatagaaaaatatagaaacgctgatttgattatatggagcttcccgctttattattttggcatgccttcaaaaaccaaagcgtttcttgaccgtctgctgccaatcaatctcccggctatagatatccatgacgacgggacaaaaggacacccttcacgatatgatttatctcatcagcgccatattttaatttccacttgcggcttcgcctcaataaaaggcaattacgacagtctgtttcagcaatttgaacttatgttccatgacaggctgactaaaatcatctgtccggagggtgagctgtttcgtgtacctgcattatcccggcgtattgatgaatatttatcccatgtaaaaaaagccggggaggaatatcatctgctgggccgtttttcacaggagacccaaaataaattaagcgaacttctgtttccgccggaagtttttatcgaaatggcaaacgccgattgggaaattgaacggataaataaagcttctgctcctgagagtcatgccgcggaggacacgtcctatccgttcctgcggcagatggctgcactgtataatcccgatatgtacacaaaagatattgttttggaaatgtactttaccgatctggataaaacgtatcagcttttacttggcaaagaaaactgcacggtcaaaactgaagatttcaccccctgcaccaccagaatcgaaacgccatttcagatatggctcgaaatttcagaaggtaaaatagacggttcggaagccatgatgaaacagatgtataaggttttcggtgatctcaataccatgatgaagatggacgatttcttcagtccgggaaaaccggcgaatgccacaccggttatccggaaacagtcgaatatgcttctgcttttactcccttttattgcaatgtggactctaatgccttttaattatattcttggcggagcagcggggatattggcaggcggattcatatctattctgcacctctggttcaagcccacaccgtatgaacgaatcggcgctttttccgtcacattggccggactcatcgtgattgtcaccgggggtgcggactggcagttatcaatccccttttttgcatcgggattgctctggctggcttcctcatttttaaggataccggtcacggcatattattcctgcaacgattacggcggtgaaaaagcctgggaaattccacttttcatccggacaaaccgcattttaaccgtaatgtggagtatcgcttatctgctatggggcgttgttgagttgttcgccgttaatacgcagaagatgctgatatttgaaatttccgtttggatcgtcacaggattacttggtttatttacggcttggttttcaaaatggtatcccgctaaaatagccggaggaaacggacacacttacatgtgacccggttgtcagatgaaacgtaactgttcagacagcaatgtcatttagttaacactatggagatttaactgaggtttggaggacgcggccggaacggaccatgtccggtgtggtgggggagtctgtctgagtcttccgtccccggttggaggttgtcgtgaggggggaatccggccggaatgaattgctgcggggagcgttttcactctttggagtgcgcatcagtgctaagctcgtgaagaacctcgctaagcaccggcggactcccatgtcccctccgcaattgattccgcctccttccccgggtcaggtttttgccggggacggaagactcaggcggaggttttcgcggcaccggacatggtccgttccgggcgctgattgtctccaaccttaaatggggagggccctgtcgcggccactacgtgtttccggcaggccgatatcaaatcttccacaattttaaaaaaagtgcattgaaggcatatcgcatttctcgtgcacggaatcactaagtggccgcgacaaggtccgccccctgcacttaacgcgtgagactatcagcggccgcaggccggcggacggggccgatacccctggcggagtctttcgtcccggcgaaaacctggccttggggcggaggggaagataaagtctgcggatgccgttgaaatccatcgctgattagcgaggtcctgccgagcttagcagcgtgatgcatttcacagagcgggagcgtgctccgcagactttatcttcgcccgcagtcccaactcacaacaatcttcccccgggacgaaagactcataaaacaatcccaccaccccgtccgctggccgtaccggcggcgtcctcacctgcttaactaaatctccatgatgttggggtcagctaaatatctttgacaatttccgcttccgtgttataattgaaaaggaaaactgaaaactatctgctatgtcggttatacggtggatttatcaaagtgaacggcatagcataatacaaaagggtggaaccgcgagccgacatgcccgccccttgcagcgattttactgcaggaggcgtttttttatttaacagggaagtccggctgttaaataaaaaccgctccgcgggattccatcgtgtttcagcaggtttatatatgaaataaatgatatatcaattgcttagacggcaaaatataaagaaggagacaaatcatgattattactttgaaggatggttcccagagagaatacacagaaccaaaatccataatcgatatcgcttttgatatcagtgaaggcctcgcacgggcggcctgtgcaggagaactggacggccgtaccgttgacttaagaactgttgtggaaaaagacagctctttgaatattctgacggcaagggatccggagggcctctccgccatgtgtcacacctgttcccatgttctggcagaagcagtgaaacgtatgcgcccgcaggctaagctgaccatcggtccgtcgattgaaaacggtttttactatgacttcgatacggagccgtttacaagagaggatctggacaacctggaaaaagagatgaaaaaaatcatcaaagaaggccagaagcttgaaaaattcaccctcaccagggaggccgccatccgcctcatgcaggaaagggatgaaccgtataaagtggaattgattcaggagcttcctgagaatgaagaaatttcattctacaggcagggcggcgatttcaccgatctctgcgcgggtccgcatctgatgagtacaaaaccgattaaggcattcaagcttatctcctcctcgatggcttactggagaggtgattcgagcaaggcgcagcttcagagaatttatggaactgcttttgcatccaaagaggagctgaacgcttatctggagcatctggaagatattaaaaaacgcgaccataataagctgggccgtgaaatgcgcttatttacaaccgttgacgtgatcggtcagggcctgccccttctgatgcctaacggtgtgaaaatcgtccagcgtcttcagcgctgggttgaggatctggaggataatgagtgggggtatatccgtaccaagacacctctcatggccaaatcagatttatataagatttccggacattgggatcactataaagacggaatgtttgtcctcggtgatgaagaaaccgacaaagaggtttttgcgctccggccgatgacctgtcccttccagtattatgtttataaaaatgaccagcactcctaccgggaactccccctgcgctacagcgaaacttccaccctgttccgcaacgaggattccggagagatgcacggcctgacccgcgtccgccagtttaccatctccgagggccatctgattatacgtcccgaccaggtggaagaggaactggcaggctgcctggatctggccgttcactgcctgaccacgctgggccttcaggacgatgtaacctaccgtttatccaaatgggatccggataaccgcgaaaagtatctgggcgatgaggaatattgggaaaaaacccagggcaaaatccgtgacctgctggttgagaagaatgttccgtttacagaagccgacggggaagccgctttctacggaccgaaaattgatatccaggcaaaaaatgtgtacggcaaagaagataccatgattaccattcagctggactgcgctatcgcggagaattttgacatgtattttattgaccagaacggtgataaggtacgtccttatgttatccacagaacctccatgggctgctatgagaggacgctggcatggcttatcgaaaagtatgcaggcaaattcccgacctggctctgtccggaacaggtcagagtccttcctatctccgataaatatgagtcctatgccggagaagtggcaaaagaattaaagaaaaacggcgttttctgttccgttgataaccgttcggaaaagattggttataagatccgcgagacgaggcttgataagattccttatatgctggtagtcggacagcaggaggaggccgacaaggctgtttccgtcagaagccgctttgccggagatgagggcgtcaaacctctgggtgagtttattgaacagatttgcagggaaattcggacaaaagaaatccgcgtggaggtcgagggagaaaagtgataagctgaacgctccgcacacggctcaccgccttttataaataaagaagctggtattaccgcactgttttaagccggtaataccagttttttatttatttatctcatgtccggcaaacaggggatcatcctgccagagaacggtccgtcctgccttttgggacgccggaaggtctatcagcctctggttcttcgagcctcggaaccggagggagatatcgtattcctcttccacaaatctgccgtccaccaggatatccagcagactgagcatctcttttgtcacttcacagaaggctctttggccctccgacaaatctgtttccagcgtataaccggtatagcaccatatatccttatcgggataaagtgttttgacctccttcaggaaagggagaagctctctctggttctccggttccatcggttctccgcctagaaggctcaggcctgcaatatacgaaggtttcaggctgtccagtatcttttgccgtatctccccggtaaaaggttcaccatagccgaaatcccatgcctcgctgttaaaacagcccggacagcggtgcctgcagcctgacacaaacagactggtcctcacgccggtgccgttggcgatatcacagtatttaatattggcataattcatgattgcctcctataaatgcagcaccctgtcacggatttcctcggtgcggccctgattccagtactgtgtcccgatatagccgcaggtacgccttgccacattcatcttgttctgatcgcggttcttacaattcgggcattcccagacaagctttccgtcctcttcgacaatcctgatttcgccgtcataaccgcattcctggcagtaatcggactttgtattcagttcggcatacataatattgtcatagataaactgcagcacgctgattacggcttccagattatcctgcatatcgggaacttccacataactgatggctccgcccggcgaaagtttttggaactggctctcaaactgcagttttgtaaatgcatcaatctcctccgacacatggacatggtagctgtttgtaatatagcctttatccgtgatcccctctatcattccgaaacgtttctgaaggcatttggaaaatttgtaggtcgttgattcaagcggtgtcccatacagactgaaatcgatgttatgctctgctttccattttgcgcaggcatcattcatatgctgcatcacctgcattgcaaacggcgtaacagacggatcggtatgggattttccggtcatatatttgcagcactcgtaaagtcctgcgtagccaaggctgatggtggaatatccgccgtagagaagcttgtcaatcacctctcccttttcaagtcttgccagggcgccatgctgccagagaatcggagccgcgtcggacaaggttcctttcagacggttgtgcctgcataacagggcctcatggcagagttccaggcgctcatcaaacagtttccagaatttatcgaaatcgccttcgctagacagggccagatccaccaggttgattgtcacgactccctgattaaatctgccgtaatatttcgcttttcccgtctccggatccacatacggggtcaggaagcttcggcagcccatgcaggtatagcaatggccttcaccgttcttatccactttactctccatcatgatcttctcgctgatgtaatcaggcaccattctcttagccgtacatttggccgcaagctttgtcaggtagaaatacggcgtaccttctgtcaggttatcctcctccagcacgtaaatcagcttcgggaatgccggtgtcacccagactccctcctcattcttcaccccctggtagcgctgaagcagtgtctcctcgataatcatcgccagatcctctttctcctgcctgttccgcgcttcattgaggtacataaacacagttacaaaaggagcctgtccgttggttgtcatcagtgtcacaacctgatactggatagtctgaacgccgcggctgatctcttctttcagacgcttattcaccatttccgtaatctgttcctgtgttgcgctgattccgaggcccctcatctcctcctcaacactctggcggattttccgccggctcacatccacaaagggagccagatgggtcaggctgatgctctgtcctccgtactggctgctggcaacctgggcgataatctgagtggcgatgttacaggcagttgaaaagctgtggggcttgtcgattcccgttccgctgatcactgttccgttctgcagcatatcctccaggttgacgagatcgcagttatgcatgtgctgggcaaaataatctgaatcgtggaaatggataattcccgcttcatgtgcctccacaacctcctgcggcaaaagaagacgcgtcgtcaggtccttgcttacctctccggccatataatcgcgctgtacgctgtttacagtcggattcttgttggaattctcctgcttcacatcctcgttattacactcaatcaggcttaaaatcttatcgtcggttgtattgctggagcgcttcagcgttctgatataacggtatgtaatgtactttctggctacttcaaacgcctgctgctccataatctgattctccaccaaatcctggatttcctctacattcatcgcatgcggcctagtgctgcacacctcttccacctgtgcggctatcgcattgatctgggctttgctcagcttctgattagcctggacaacttcattcgccctgcttactgccatcataatctttgatatgtcaaagactgcttccgaaccgtttcgtttgataatcttcataccccaaacttcctcctgtgactcttactatatattgtggttcatttcaatcgggcgcctggcccggtactgttaattgatgccttattagtataagacaggacacggaggctgtcaactgcaaaataccatatattagctcattttttatttaacaatacaatatatagtgttttatctctgatttcttccatgtccccccaatatatccacaggctggaaagcccctccattcaaggaaaaaaaggcttttggcacatacggcgcactgtttttctctcctgcgcttttatgattattttccataaattcccatccatattcccgttcccggacaaaaacacagccgcccaaaacgagcggctgctgcttctttttatctgtttatgtattggattgcaaggcatcgcgggcctccctgggttacaaatgccgggcccagttccagaatcagaatctcaagctccggaaaaatctccgccatgcgtcttttgacagccgccgcatcctccggggcgcctgcatgggacagaaacatcaagtgatttttcccgagttctttcttcttaagatggccgataatactgtccaccgctgccgtcatcgtccgtttaacaccgaacttatccagcttcctgccgtcctccgtcagctttaccaccggctttaacttgagcagtgagccaatggccgcggcaaccggagtcagccttcctcctctttttaagaaagaaaaatcctgaggaatcagaaacgattcggtattgcgggccgcttcctcaagccacttcagtatctcatgcttctccctgccctctccggccattctgtgggcctgatccaccatataacggtgcggaccgcacaaggtcctgctgttaaatacagtgatatcctccttattcttagccattgctctggcgctgcatgcgctctcatatgttcccgacaggccgtcggccatagagatgttgataatcggctccccccggtatttctcataagtatccagcacctcgccaataggcggctgtgatgaggtgggtatctgcccctcatcgatccgcttataaaactgcggcatatccatctgcaaatcccgcccgtggcagtccccgatactgacgctgagcggcacagagtcaatccccgtatctctcccctcctccaccgtatacagtgatgaggagtccgttataatcctgaccatgaaaagtccccctgaccgtatggctgatatcctcataaatccaaccatacatagttatcgttactatgtattaaagtttatagtatgatatctttgcagtcaagtcttttcgccttttttccacatttttctacatttttcgcgcatgcgaccgtatcggtatcaccgtattatctcttagtatccaggctcaaaaaccgcattgtcttccagaccgatatcagaagattcctcccggtcaaacaccagattttccccttctagttcaaacacgtagaccgcgtccgccccctgccgcttcatcgtgattttgtcatccgccctctcatatgtccctgttggaacggaactcataaggatggagtactggaagataaagctgccgtcctcatccagaagaacgtatggtgcaaccgcctcctccgatttgacgaatatatactttccctccagcgaccccggattcggcctgtaaaagtgaaggtattcgctgtagatattatgtccgctctccgcaggctgtccgtcgacggtaatttttattgcatatgcatcgaatgctttgagaaatgtattgacaacgcctcccatatagaaatactctcccgatgtgcccattcggttcagttttccaaggaactcctggttgaaatccaggtcaatataagtcattccctctttttgagtcagctccatggaattcaccttcacgcctttttcaaggacaccggcttctatcagcttcccggccaggttctccgccgtaatttccgcaaggcggacttcctccgtcagcatcctctccaccgtatcattcccgcggtaaatggtcaccgggtttccagcctgctcctgcgtctcctgatccgtctcctctgcagcggcttcatcctttatttctgcgctctcttccgcttccgcagccgcggcgctgctctccaaactgggctcctgtccgctttctcctcctgcacacgctgccagaatcagggacaatgaagcgatggcaacggcggtgagaaaccgttttcctgtgtttccttttctcataaaaatcctcctgtgatacgcagataaacaattacttacagcctcattgtaccacaggagtgatttgaatttattggggattctattacgcattcttacaatattataaatatatcagctcttccccttatctctgccggttcgtcggggaaccgattaaaaagccgacgcatccggaaacgaagtcacggaactgggcaacggtggctgtcgcagaaggcgaagcttcaatcccctctccccagccgcccacgtttctcagcagaatcagggtaaacaggcaaaacaggcctaccgccgccgcaatcagaatctgaagacggcctgattcaacaggatgttcttccttattctcttccccttcctccgcagcaagctccttttccgtgaaaacgccttccacactctgctccctcagtcctccgtctcccatccgtgccgtttcctgctgtcctgagccggatgcaccgttccggataaaattggcgcttaaaaaatatccgaaaattgcggcggaggatgttcttataattacatcgatttcatttgcctgcgccgtgttacccggaaatcccagcagggtacaggcggactgaatcagcaggattgtcataaacagaatcaggcatttatcaaccagatgtattccggcaagctccggccgtatccagctacacttaaaaattcgctgcttcacgcttctttactcctttagcttattggcggattatcagccgaaaaaccggactgtgacatttagttctcttctgccgtgagttatccggtaatttcaagtatgtccgcctcttatatgatatgtctgccaactgtgtttgcttacggcgtccacccgttttacaggtggcggcgacgttccaatctttctttgcatctttcaatttccgactcaaacccggttccaattttaagataaatctttaatgcctccccgtaatactgctgtgtgtttttcatcctgagtccgcccttttcccaatataaatctccaaggtttaaataggaggaagcaagatattccattttatctggatcttttaatctgatatccaatgcctttaattcatatttgattgctctgcgtattttccctgctttctgaagagttgtcgaatatacatggtatgatacccctaacgatggatggtcctcattaagaagagacttttttatttctatcgcctcttctactgatttaagcgcagcctgcaaatattgtttatcctgactttgttcgtacagcgttatataaacccgtcccattgaacttaaagcttttgcatagtcaatattgttgcacagctgatattcgcggcaatactggatacactttgcaaattgatttttagccagatcatatttcttttgtttaaacagaataatgccgtagtgtatatacatcatcatagatattctgccatacgcaaccggttgggtatcaattttgctgtaaatttctgaaatatagcgttcagccgtattcaaattcttatcgatattggtctcagacaaatacagtgcaagctggatagtgctataaatgtaatactttatgtccggacaattcgaactcttctctcttgctttcatttccctctctatggctttgtcaaaataatcttcgcccataaaccaaaaggcctctgattgttctgacataatcataacctgcaggatataggcctcatccgatttttcctgtgcttctgctattatctgagcatgttccaaaaatctttgagcctctttcgcattaccccagtcattttcgagacggcccaggtaataatagaggaggccgttttcaattatcggattatccctttgaaatgtcaaaaacagttcgacatacatcgcgctataatggctgcttttggtgctaaaagattcttgcggatatttcacccattcgattaatttacgtgtaagatttcttcgttcctccctggagagcggcattaaatttcgaacaacctccccaataacaggatgtattttaaaaatctttctatcatgagagttcagccaggactcatcatataagcgatacacatcttttattgttactccctcacagatagagagaattgaatctgaatcccattccatatccgggaataaagaaagtatagctataatatgctcacggataccattgctgaatgatagccttaaaagtctggttatgcagtcaataggtttctcatattctccgccattttctatcttcactacactgtccaatgctgacaccggagaatttctgtcagcttctaattttgcaagaagctcttcgggtgtcaaatggttcgtttttgcataacaagccaataatttgatagtgaggctatgccggccacttaactgaactaaagaatcccctatatattcagagcatttttcaccgtaatagtatgaaaataaacgacatccttccctcctctccacaggcataagcaagctgctattttctatcccttgtaatcttgtcgttattataataaatagtttccgattcgttgccagttgatcgaaaaaagaaatatcatcaatcccgaattgatcggcgccgtcaaatataagcagggttctttttgaaatcctcaacagctcaccatacacaattctaaatttatcttccattgaagagacggcccctgcaatctccacattaggagaggaggtcagcgtcattttatagtccgacctccatttaaagagcagcgcagattttttaaaatatctgaaagctataaattccgcaatatggctctttccaataccacccattcccgaaatccagacaatatgtctatctttcaatttctgataaaagattcttgaaatccgtttacgcccaattaacttgcttcccattgtcggcttttgaaatataacggaagtgtgatactgcctagtcatagcctttctctttaaaaatccaaatgttcctccaaatatggcagctaatccgataattcctgaaataaaagattcgttatctgatataagcttcgcaatcaactttaagagctccagcatcttcttctcctcttacagttcagcgccatatatgccgtcgttctctacccctgagccgccagcacgccgtcctccccaacatacttgccgtccggcgtcaccgagttcgtcagcatttctccgttctcattcaggaagtaccactgctccttccaggagacccatcccgtctttctgtagccgttttcatcgaagaaataccattttccatcaatctgctgccagttgtttttcacatagctcccatcagaattacagtaccaccagccgacggcatcatttttccaggttccggcagccggcccgctgccgctttgtttgtaagctgctgcagtctggatttctgcggctttttctgcggtaacttcaaatatatcagattcctgccactcgccttttctggaagaattatacagtccacgcacttcgaaccggtaggaaccggcgctgtctatatactttgaaaaatcgtaatgtgtctcttttaccgggtggattgtcgtaacaaacttttcattgcggtaaaggcgcagctcataataagcggcatcctcactgtccccccactctccgactgcgctgaattcattccactccgcatcctccgtgtccagatcgtagtcattgtcgtctgccttaagcgcatccagggtgatggtgacaatcagttcctcatcactctttcgtctcacggaagttacatcgccgccggaacccgtcagctttatttttctcttggtaaatcccgatttaaaataataatcacgttccgcctccagactcacctgaaccttcggcttatctttatgcttccattccccattcggctcattggtgacatccacgttggacacatagcattcgtcggaatccgtcgtcaccgaaacgtcggagcccgtatctctcacctcaatcgccgactccacatcaagcgacacttcctcaaccggagtccggtcctcctctgccagcgccggaaacgggcctgatatcgccatgccggccgccgccagagccaggacccaggtcctgattgattttatgtcggttcctttactatttcttattgtattcctcatatctattcctcctgaaatcctgaagtttctttcgtttccagctgttatccgtaatttccggcagactgcatcaggcggccggttcctctgccgccacgctgctctccacaggatacggctccgtcagacagtaatctgaaaccttccattcctccccctctttcttaagggtaagaagcagatagtacataaattccgaatctttctccttcacctcgcacttcaattccagctccccttgtatctcctccggcaaaaccttggatgcaatgaaatacgaatccattttgccataatccatcacagtattgacatcggtacgagcagcagcttccctgctctgatgtttcttcatccccttcagactgccagaagcccagtcatcgacaaagtcaaaggcagcatccataacctccatctccacattgcgtttgtactccggggatgacggaccggccggaatctcactgacacgtaccgcagtcccggaaccggatggaatatcatgcaccttttcctttccatatccttgtatacgccataaaacaaacaatatgagaaaaatagcaagcgcaaatacgatgcatttttctttcttccccatcctcattaccctttctccgcaaaaacctgccgcaattcaattatatggtaattttaccacattttcagacttctgtctcccttattcctctttcaatagaattctcttgatttatcccggcatttgtgctaaaaacgatatagcaccattcatcattcacgaataaaaaggagaggatacaccatgagttttaaggaaataaaagccgaagatttacagttcaatccctttaccagaatcggttccgactggatgttaataacagccggtgacgagaaaaaattcaataccatgacggccagctggggcggcgccggcgtattctgggggaagaatgtcgtgacctgctacatccgtccccagcgctacacaaaggaatttgtcgatgccaatgataccttcaccctttccttctacggcccggaatgtaaaaacgccctcaatctctgcggcactgtctccggcagggaccgcgacaaaatatcagaggcaggccttactccgtattttacggagggaaccgccgcatttgaggaagcaaatcttatctttgtctgcaggaaaatttatcaggacgatatgccctacgagaattttatcgccaaagaaaatgacgcaaaatactatccgaataaagattatcacacgatgtatatcgcagagattgtaaaaatccttgtggcagaatgacagcctgtactgaatacactgactgacggctgccccgtttcggcttgccaaggcaggtaatccgaaacggagcggccccaatggttaaagatactgcacccgttactttctgaatatatcgaccgcatggctagtactgcccgctaaatccccgcgttcgcacgttgcgaagtggtatctcaagtacagttcaaatgtatcttgatccatggcctcaactgcttcccgtatcaatggggcacagccgtctgccgcaacgtaatgaagccgggtcacgggaaataccgacatcaattcatcgatatcttctttgcggacgagttcaaacaaatcctttggctcagacctggcagcaaatgtccgggaatcaagaaggcccatcctgatgtattcagctacgtttatattgccccgtttaaacccttcatcgagcagacagccgtcggatatgacataggcggcaaaaatcactcccccctcctttgtcacccggattgcctcgcgcagagcctgttgtttatcctccttgcaatagaggtggtacagagggccaagcaggagcgttatatcatattgattgtccaaaaaagcgctgagatccatcgcatttccctgagtaatggtgacattttcgtctgcctgcatattctgtcggaaaatctctatgttatgcgctaccagctccacggcgtctacggtatatccacggcgggccagcgcatgggaatagcgcccggttccggcccccacttccagcacgcggcagcccggcctgagatatttttcaatgtagcgcatcgtagtgaggaactcaaccgaaccatgccgtaacgccagccggccgtcctcatcataatgattgtagaaatcagtgatatacctgttttctctcatatcgcgtcctcctgtcttagcggccgccgcacatcacgtgtcaaccggcagattccactccggttttacctgtcttacaaaagccgtcagtatattacccaccattttttcagcgctgtctctctcaaaccttaattttttcgttgcggccagcactgctatcccgtgcgtataaagaaataaatctaaaaatatgactttggcgtattccggttcgatgcctatgatttccgaaaaaatctccgcccttttttcgtttccgctatctttataaaaatcttttgcctcactcatttccaggtccatatcgttgataaacagcagtttaaataattgtgtttcttcctgggcaaattcaatgtaggaaagagggaggagcagacagggatttacctcttcaaatatccggtaatcctccacatatttctcatagtattcataggcaaatgtaagaaattgttgttttaattcatccatattttcataacaggtgaatagcggccgggtagaacaatgaagctttcctgcgatgctccgcgcatttacagtttcaaagcctgtctctctcgtgatatccatgacggtattcaatatcatttctctcgttattttcgctttaggcggcatatttttcacttcccctatttaaacgataacctgcacgctccgcgcacaaatcaccgccttcaacgataacctgcacgctctgtgcacaggtcaccgttatcaatcatattatataacatatgttatgcaacaattgttacacattagtcctgttttgtcaagaaggaatttcagccgcagaaaagcaggccgcctgtgccacactcttccaagtgggcacaggcggcctgctttttaatctttatctgctgcttttatttctccggacgctttgaaaatattctgtcttctatatcatatattgtaatctgcttcaaccgtttccggcactcctgatccagggtatcataaatctccgtcatcacaccggccatccccgatgaaacgaggcagtcgcggtcaggatctccgcttttccatgatgcggctacaaatggagtatcaagggcgtccgctatcatctgcaaatccacttcccgggcctctctgtggaagaaatatcctccatcggccccctcctttgtcttaatcaagtctgctttcttaagtttcgccatcactttacggattctggccgcattggtgcatacattgtccgccagcccttcgctggaataataagtacccttatgtgatagaaacactaatgcatgcacggcaatcgtaaactcgcttgtcactttttcatccccttttccttactttcgttttccggccatcgtctggtctatgatgctcttcatcatatcttcgctgagctggccgctggcgtagccgaatacatttccgtcgcggtcaatcataaaggtcgtagggaaggagaagattccgtacgcgttaaatatctctcccgtcgtatccatcacgacaggatacgtatatccgttatcctccaggaattttttaatgccctcttcggactgttcgcttcccatattcggggccgctattcccaggacgatcagcgcatcgtcgccttccgtatcataggtatcatacagcttctggatatccggcatctcggcgcggcacggcgggcaccaggttgcccagaagttcaggaagaccgttttccctttgtaatcggacagcgtatgagtattgccatactgatcctttaatgtaaaatcgatggcaggcatcggagccggttccgtctctccggatgcgttttgttcggaaccgctttcattcggaccgctctctttagcggcgttctcaccggaacccggttcttctgctcccgatgcagaaccgctctctgctatttctccgctgctctccatcccgtccttcgtttcttccttcgtctcttcctttgtctcatcgccgcttacaacaccggcgctgtacccgctgccgccggacggggaaattcttgaaaggtagcctgtcacggaattcatcttaccggtgaacataagaattcccataaataccatcaggattccgccgattctcaccgtatatttgacaacgttcatatgactcttgaaaaaatccagaagcgatgtcgtaaacaggccaactgcgaggaacggcagaacaaaaccggccgtatatacgccaatcagcacaaatcccatcgcctgggtgctggctgacgccgccatcagaaggacactggctaaagccgggcctacacagggcgtccaggcaaagctgaaggtaaagcccataaccagagctgtaaatggtgacatcgccagtgtatccagcttaaaggggagcctgcgctctttgccgagcagggaactggatccgaaaaagcccagctggtataatccgaacattacaaccaggatacctccgactcttgcaaacataagctggttatttttgaaaaagccgcccatggctgaaaatcccaatcccagaaggaagaatgcgaaactgactccgattacgaagcacagcgtatgcagcattaccttgcttcttttatagtaaatccttccgtcttcgccgcggcttcccgttcccccggacagatacccgatgtataacggtatcagcggcagcacgcagggagagaagaaactgatcaggccctgaaaaaacaccgtcagaaccggtacactgatatctagtgaaaaacccatatagtacactccttttatgttgtaaatttcaaatttagtctgttacggccggattacacggcaaataactcgttaagagattcggccatcgtcggatgggtgaaaatcatgtctctgagtacggtatagggaagttttgcatccatcgccatcttaataatattaatcagctcataggattcttcgcagaacagatgcgctcccagtatcaggcccgtcttctcgtcaattactgccttcagcaggccgtccggctgctctaataccttggatttgacaatctcagacgcggaaaccgttgcgatctttacctggtacccagcatcccttgcgtctttttcgctgagtcccactctggaaaatgccggggctaaaaatacgctgtacggtacggctcccctatctttcagtgtataactgccgtctccgagaatctttgatttgacgattctgctgtcatccagggaaatataggtgaactgaagtcctccggtgacatctcccatagcataaacatccggagtcgtcgtcatcatcgaatcatccgtaattataccgcctctggcattcacttcgataccggccgcctccagattcagctcctttgtattcggcctgcgcccggttgcaatcagtactgcatcggcctccagcttcctgacgccttccctgtcttcaaacacgacggcagccctgccttcagcctgttcaactgctttgacttttacaccggtcagtacatcgattcctctgcccgacagcgatttacggacagcaccggctatatcagcatcctctctcggaaggaaaacatccccatcctgaagtatggacaccttggaaccaaagcttgcataaatcgaagaaaactctacgccgatataaccgccgcctatgatgacaagattctttggcaattccttttgctcaaggagcgtctcgcttgtatagacataaggatttcccttcactccatcgataggcggaacgaaagccgatgaacccgtatcgataaaaatctgcttgcccgtaagctttaccgtattcccgtcccgctccacttcgacatcatgagaggaaacaaacctggcggttccatccatcaccgtgatatttgggtgatttgttaatttctgataatttgtttccctgagctttccggtcaggctgttcttatgttccaccgcctctttataggccctggctttatcctcaaagctgccgtctccggctgatataagtcctgcgcggtatacgagtgatttggtcggtacgcagcccacattggggcaggtgcctccgtgcattttgttggaacgttcaatcagaaccgtcttctttcccgcatcacccagcgctttcgccagtgtctttccgccttttccaaaaccgatgatgattgcatcatatttttccgttatttcgactgatttcttctccatttctattcctccttgccggattgttttatatgtaattttatttgttacagttcttatttgtaactttatcagatacagttgtatttgtcaagaactttttggggaatttgcgaaatgagatttaactgaggtttggaggacgcgtccggaacggactatgtccggtgtggtgagggggtctggctgagtcttccgtccctgtgggaggttggtcgtggagggggaatccggccggaatgaattgctgcggggaccgtttgcactctttggagtgcgcagcggttctaagctcgtgagggacctcgctaagcaccggcggactcccatgtcccctccgcaattgattccgcctacttccccgggtctcgttttcgccggggacggaagactcaggcggaggttttcgcacaccggacgtagtccgttccggccgccggcgatataacctcacaaaaatgtatttctgtactcctgcctgacaggctccgggaccaggttgccccctgtcgcccaggcgatatggactgcccgggccatcttatcttccaggcagtgaaggcggagatattctttcgtctcctcataacggttcagcataaccggcccggcaaaagccgcgcaggcgcttggttccagaaatacttcctccgtatccagcagatctctgagatattcatagagatttgcatcagacacggtgaagattccgccaagcagcggctccatcatttttccgacaaagcctgaaggccttcccacagccagcccgtccgcatgagtaattccgctcaggccaatgtcccgtacggatatatcattatgcaggcccgtcgccattcctgccagcatgcagggcgcctcaaccggctccacaaaaaagcagtgtacgctgtccccgaacacccgtttcaggccaaaagccacaccgccgggcgcccctccgacgccgcagggaatatagacaaacaaaggatgctccccgtccacaatgatttcctgcgccgccagctgggttttcagccgttttgccgccactgcgtatccgagaaacagattttcggaattttcgtcgtccacaaaatagctgtacggatcctgctccgacagtttcctgccgcttttgaccgcgccgctgtaatcagactcatattcgattaccgtcacgccgtggctgcgcagcagctccttcttccattccctggcgtcggccgacatgtggacgatgacctgataacccacggctgcgctcataatgccgatactcagccccagatttccggttgagccaacctggatcgtgtagcggctgaaaaatttcctgttttgatcatcagccagtacctcatagctgtctttcaaggtgataagaccatgctcgagggcaagatcctcggtatgctttaacacttcataaattccgcctctggccttgattgaaccggcgattggcagatggctgtccagcttcagatacagcctgccggaaagcttggccccatatttttcattgatgcgtccctgcatcttcggtaccggaacgagcgccgattcaatcattccatccgctgcgtccgtttcagggaaacagcgcttgataaatggggcaaaacgctgcagcctggcctctgcgtcatccacatccgccatggtcagcttgaccgcctgcgcttgctcttcctccgtctccgtccttccggcttccggattaatccatacgagttgttttcccgttgtaagtctcgataaatcgaaagcaggctttaattcctgccgttctatcagtaaaagtgcctccgtaagcgtcctcaccgttgtaacgccttgacagtgttttattcccttcctgtccagaagcaccggaagaatcccggcggataaggcgccttttacatccgactccggagaatccccgatgtgaaccacctcgtcccttgcacagccgctcacctggagagccagctcgaacagttccctgtgcggcttatatgcgcgcaccatctcgccgcagatgattcccgccggattaagccccttatcccgcatagattccttcacatagggcaggccattgttcgttatgatgtaaatcggcagactgcatttctcaaaaaattccgccgtatcaggaaaagccggtgcatacatccagaaccgcctgcaaagctcatggatttcttcgaaattctccttcaggtgaatctctttttcacatacttccagcgtcctgtccacgatctcatcctgagtcagaaatgaatcgccgctgcttgcggcttcaaagtatttaatcagtttccaccagtaagccagcatagattccatactgtcgatatcgctgtttttgtagcagcgcctcagcatctgcatggcatcagggccgccctcctcaatcatagtaccggtgtagtcaataaagactgctttcagcatggtatccttctccttctgactttatatttctgaatcttatatttctgaacttatataaaaagttcgttcttttttctgccggaacatgcttttttcatcttttgcgaagcggcaaacagcaccagcctgtttaaatctctggcatggcgcgggcagactgaaatgcaacgcatgcaggagatacatttctccttgtcaaccgatgacggtttctctgccagtatcgccccggccggacattctttcgcacacagaccgcagccggtacaggaattgtccgcttccggcttaaatggcacgccgccatactctctgtacggcctgtttccggggagtcccgggattctgcccgtctgttccccctgcaaaacgcctgccgcctcttcctgccctccggattccttctccagacgctctcttatccgggcggcaaaaccggcaagctctttttcatcctctgcgtccggccttccctgaccgaactggtgcatgatggaatgctctgcaacagccgcgactgccgctttacagtcaaagccggctaaaacaagagtatcctccagctccagcagcgtatcctcaaatgcacggttgccgtaaacagcggccagaatcgttttcgcatgaccgccctccatctctttcagccgttccaggaccagccccgggacacggccgccaaaagacggcgccgccacaatgcagatatcttccctggtgaaatgatactgtgaataatccgtcccggccggtgacaaatcaatctctttcatctcccagccgccgttttctctttcattgctcagggcgcggcttacaatatccgccaccttctttgttccgcccgtcgggctgaaatatattgtataaagtgtccttcttttctcaaatttcccggcaaggctctgcctgtgctcctcaaatgaatgtttctccatggaataccccctacggccaatatttattgaccattatatacttttatttccattcgttcaagtttagtattatcttcctctctgtcacatctgcccactgcgccgggccggatttgaaccagcacataaaattacgggatataactgtccaggacggctttcgctttgccaaccaccagcccgctgccgccttcattttttacatcttccaccatacttaccagcaggagcggtgtatttatgtttttatctgccgtatatacggcaaaccagccaagttccgttccgccagtatcctcctttgatgctttgatttcagcagtgccggtcttgccggccagtgtaatatcctgcctcatggctttatgtccggttccgtgcggtgaactgataactttgagcagtgcattttcaatggtttgagccgtttcggctgtgcaggcctgttcaatccaggcttcaggggacggctctgccctgtaaagaaggtatggttttaaaacggtaccgtggttggggaacatcgtgtataaagccgccagatgaacgggatttatcagtatctctccctgaccgtatccgctgtcggcaagctggatttccgactcaattttctccgtattggaatactgggcttcggccaccgctatctcaaatggtatcttctggttgaaccccagacgatcaagtccggccataaaatcctcggagccaatcttcagcgctgccttggcgaaatagatattatcggaataaatataagcattctccaggtttaccggactgtatccgtgaagtgtcgtcacataataaccgccccagccggcatccttctgccagcgcagtcctgcctgtgtctctccaaaattctcatccgggctgagagcgccggtgttcaggccaataaccccggttatcggtttaaaggaagaacctggagcaaagcgctgccggaaacggttcagcattggtttccgttcgtcctcattcagcgccgcccatttttcctccgacatgccgtagataaagtcattgttgtcatagctgggggtattgaccagagccagaacttctcctgtaaacggattcatggccaccgtgcagctcttgcggtcctgatacgtgtcgtaaatcatttcctgaagacggctgtcgattgtcagcctgatatcctgaccgtcgattcttgtgactgacgccagaaccagcttttcccgcccctccgcagataaaatggatatacgcgtgccgttccttccctttaactccttttcaaacaggctttccatgccggttctcccgattacgctgtccgtcaggtagccctctccctgatgctcttccagatcctcggccgttacattctggacatatccaaccaaatgggcggccttctctccgagaggatagcttctgacaggcgtatccgtgatcatgacgcccggaatcgtcaggagttcatcctgcagcgccttattccggagattctcctcatcgccggatgcagtctgaagctttagttcatccacgcactttacagtctttatcggaaccagggaatcatccttcacccaaccggcagacagtttttttgtaatattctcaactgatataccgagaagctgtgaaagtctttgtaaatcttccccggaatacccggactcattccccggttcacggctcatcctgcccggtacaagaccgaccagggatgcagtcccctctcctgccagcagattgccgtttcggtccaggatacggccgcgcgtcgccttgtcagtgctcaccctcaccttgtcatccggtcctaactgaggaaagattaacctgtcgctccaggccagtttatattcaggctttcctttcgttccttcttcaccgggcacttcttcccgaaaaaccgcctggttaaaaaagcttatttctccggccagactgtccattgtggtttggtattctaccgtaccggtaccgtcttctttcagctcagtgccctttatttctatcctgacgccggacgcctcgatcccctcgtatatgttcttgtttctcttttcaaaatcttccaggctgatattcaggcggctttggttatccaacatcccgtacatcgccccataatcgccgtccgccatatactgcatatattccgtcagcagttcctccggagtcttcttctcctcctttatccgcctctgtgaataaaaccaaaatgcacctgcggctgcaatagccacgctgcacagcaatacggccggtatcagcaaaacggctcttgatcttcttctgcgcctcatacgctgctcctttcctgtgattgaactcaccttcgataaagactgcggcagaaactcgggctggcaatttatcttatatattcatcttcgtcatcaaccggccgccaggcctggccgaatttcacatcccggaataatgtcgccagccctgtaatctgcttaagacgcagaatctcatctctgtccatgcccagatgtttggatatccatgcatccgaacgtcccaattcatgtaattcttttacaatgttgctcatcaaatccacattgtgggttcccctggccctgttgtggcggattgtgctggccatccgcttatctagcggtttattaatgaccgatacaggcagcagcccctgctccctctcatatatgtccggatggttcagcatcacctgatagcggtggaagccgtcgataataagataaatatcctgtgcttttacataatagcagactacaggcatcgtataaccatcttctttaatgctttcatacaaaagacgcatttcgggaggcgctactttattaggattatacgtattcggctttactttttcaataggtactgcaattacatcataaaccgggcttcgataactcataattaaaatcctctatgctttcgtattttttcttaatcaggtctaaacgtttctgctgctggcgggtcataccaaaacccataaaacggcagatgtgatcatttttcaggatacagtaacacattcttttccagcttggtatatcctttgtcgtcttgatattgtccgtattatcaggtatcggtccgagaaagacaatacgagattttttatttacggtatagttggaaacgccattgcgccttatcttatatccgttctccaccagctcctggatcgttttttcgtccagcccgcctcccgtctcatgccagaactggatcgaggtgttgaattttttaacatagttattgcgaagcctcttcggcagcgtgtccagcagaaaatgggtataagatttccatgtatgcccgggcggaagtgtaatagtacggtaccccattgcctttgttcttccgtagatcgaagcaaaattagcgccctgcacacggccgatcagtttacaccaaatctcagggtcgatcacccggtacaggttgatcgcgtccttcgagtaatcgttaaaaggcgaagcgacccgcatctgtgataccttaagcccggctttatggtaaagatcataaagccggttgtaatcataggaaaacagataattggcatgccaaacatcctttgcgctccagtcgtaaagcggcgaagcgcaccagacatttttgaactggttgctaatccagcactcgcctttatagccgtattttttatttaaaaatccgctgtacctttgcagggattcgtctgcccgtattccaagaaggctgaccgtcttcttgtcaccgtgtatctgccggtaccagcggccgaactgttttgccagatcctcctgatgcatgcggtacctgtatgtagtgataggattgtttgataaattgattacatattctttgtcgggcatttcgcggacccatagctcctgttttgtatcgtcccatggataccagtacatttcatagctgctcagggcagttctggtggccattggcaggcaaacccagtaaatctccgcctcgtcttttatacgctccagtgtccgctcaatatattcggtggttacggtatattgggcctcgaaatcctgatgaaatacgccgatcgtcttatccggataatatttttttttgtagtcaagaaccagatttaaaagcaggccgctgtccttacctccggaaaacgacactaaaatattgtcaaattcttcgaagataaaatggagacgctccatacatgcctcatagacatttttttccagatactctcttttcatttttccctcccttaaataatacgcagcaaactaccctgccggacaggaaacgccaaaaagcctggagaatttctgctcccggcttttggtcccccaatactgaggatactgtataatcaccgccaaatctaatactccttttgtatcaaatactacagttccatttcatttttcaatatctcatgcacataaggtgctccttctaaatacaaaccaatatcttgcttcattataactgctacatcggaattttgtccagtcggtttttatcatgcagtcaggagtcattgctctgtctttacggctatccaaaggaggaggaagagacaagttgtcaaaatcctttacccgatccctccctgcgcactttattgccatcttcatccttaaaacaagcaatggaggcagtctggcattcagttcgtctataaacaatgttccaccgttatcctgaacatctaatgtaaagctcttgctcgtatctttctcattctccggtggtaactcctccacctcaaaatcctgtatattcaaaaaagacagctatgctcgtcagaacacagctgtccataaaaatatctatttcatcaatttacgcttcatcaatcgccttgccgatatcatgcctcatatacttattatcaaattcaatccactccgtggcctgataagcattggctctggctgccttcaaatccttcccggttgccgtgactcccagcactcggccgccatttgtcacgatattgccgtcagcgtcaaatttagaacctgcatggaaaacatagtaaccgtctttttccttgaagttttcaaggccctttatcttgaagcctttctcgtatttaaccggatagccgtcggaagccaggacgacacagacagccgcattgtcctcaaattccagttcaatctgatccagcgttccgtccacacaggcttcaaaaacatcgacaatatcattcttcatacgcggcagaaccacctgcgtctcaggatccccgaaccgggcattatattccagaactctggggcctttttccgtcagcatcagaccgaagaatatgattcccttaaaggttctcccctctgccttcattgcatcgaccgtagcctgatatacatatttgcggcagaattcatctacctcctgcgtatagaagggacttggggaaaatgttcccataccgcccgtattgagcccctgatctccgtcccctgcacgcttgtgatcctgagcggaggtcatgattttaatcgtgtttccgtctacaaaggagagtacggaaacctcccgaccggtcataaactcctcaatgaccatctggttcccagcggaaccaaacttcttatccatcataatttctttcacgccggcttccgcctcttcatgggtattgcagattaatacgccctttcccagagccaggccgtcggccttcaatacgataggcatctcagccgtctttaaatataaaagcgctttttccggatcgtcaaaattctcatatccggcagtcggaatattatatttcttcatcaagtctttggaaaatgctttggagccttccaaaatcgccgcatttttcctcgggccgaatactctcaggccttctgcctcaaacacatcgacaatgccgcctaccagcggatcatccatgccgataatagtcagatcaatggcatgctcctttgcaaaagccgccagcttatcaaattccatggccccgatatccacgcactccgcatactcggcaattcccgcattgccgggcgcacagtatatcttgtccgctttttcactctgggacaccttccaggcaatcgcatgctcgcgtccgccgcttccaacgattaaaattttcattatctcatgtctccttatgttatcagcaacatttcagacagcatgaactgttactgcatccggcctaactaaatcgctgcgcgttgagccgaatgattgctgccaccgctttttcacacggtcagcacggcaagtatgcagacctgtctgaacggctgctgttatcgaacttctgctatcatattgattgcctgcggaagaattacccactccgcctcctccatgacgcggcgctggagaatctccggcgtgtcgcctggtttcacctcaactgccttctgaagcaggattgggcctgtatccgttccttcgtctacataatgaaccgttgcccccgtcacttttactccccgctctaaagccgcctcatgaaccttcagtccataaaaaccgactccgcaaaacgacggaatcagggacggatggatattgattatcctgtttttatatgctgctatcatctcttccggtatctttacaaggaaaccggccagcacgaccagatccaccttgcaggcattcaccgtatcgagaagcgctttgttaaactcttctctgctgccgtacgctccgggtgtcactacaaatgccgggatgttatgatccttagccctctggatggcataggcattcgcattattgctgattacagccgtcacctcggcgcccttaataccgcctccgtcaatggcatccaggattgcctgcaggttggttcccccgccggaaaccagcacacctactctcagcataaagtcactcccttatctcccgcttcgatggagccgacaacatacggaatctcttcagccgacctgattgcttccatcgccttatccacatctgccggatcaacggccagaatcatgccgagtcccatattataagtgttgtacatcatctcttcttcgatattgcccttatcagccagcagtcggaaaatggccggaaccgcatagctgtctttctttaccacagcgcgcgtgccttcttttaacatacgcggaatgttctcgtagaagccgccgcctgtgatatggctgcatgcctttatcgtaatcccggcatccttgacggatttgagggctttcacgtaaatttttgtcggggcaatcagcgcttcaccgagcgtggttcccagctcttcataatatgtattcaggccttccgctgtaagctcctgttcgaataccttacgcaccagagagaaaccgttactgtgtactccggaggaggccataccaatcaggacatcgcctgccgccagtttctcaccggttatcagatccttcttatctaccgctcccactgcaaaaccggccagatcatattcgtcttccggatagaaaccaggcatctcggccgtctctcctcccactaaagccgctccggactgtttgcagccctctgctacgccgcttacgatctcggcaatcttctccggcacattcttgccgcaggcaatataatccaggaaaaacaggggttcgccgccggcacatgcaacatcgttgacgcacatggcaacacagtcaatgccgaccgtattatgtttatccatcaggaaagcaagctttaacttagttcccactccgtcggtaccgctgagcagcacaggctcgtccatctccttaaaagctgctgcggaaaaagctcctgaaaatcctccaaggcctcccattacttccggtctcatagttcccttcacatgttccttcatcagctcaactgatttgtatccagcttcaatatcaactccggcgttcttgtaatccatcattttcctccagtatttttagaattcactgttataaagcgcagcgcagtaacggggcgcagcgttctgtatcatcctctgattatttcttcatacgggctacatactctttatagccaatctcatctaatttctcagctttggataccacttcattcttcatctcttccgaataatccttcagtttctgaagaagctccggatcggaagcagccagaatcttggcagccagaattcctgcattctttccgccattgatggcaaccgtggcaaccgggataccggacggcatctgaacgatggaataaagtgaatccaccccgcccagatctgacgtcttcatcggaacaccgataacaggcattgggaacagtgctgcgcacatacccggaaggtgggctgctttgccggcccctgcgatcatgaccttgtaacccttctcctctgcggatttggcatattcaaaaaacacatccggttccctgtgggcagagataaccgtcatctcaaattcaatccccattttctccaggaaatccgccgcctgagccattacaggcatatcagagtcacttcccattacaattcctactttagccatagttcattctccttttctgctgttatcatctgataattccactttcgcttatccggccgtaaggcggattaattcattactgtttcataataaatttattagccatacttataagtagttttaattaaagtaccattacttattagtaatgatactaggttttttttggcaagtcaataggaattttggagatttgaatgagaatgaaggatgcgtccggagacctcgtcgctgccaatgcctaatggcgaaaaataataatatgggcagcaattcttcaatataaaaattatactgaaattacgccagaccaaacggaattaaaaccggtgatattcttccggccttaattccgctcaatcagcatcctaacctgcttatttcattttttcctggcactcgctgcactccctgtcatggatagaaatgatacccccgcatttggtacaggtatatttttctttctgctgttccatgaaccgttccaaaccatattgacgaacaaacccgctgttttccataaggctggcctgataccttttattgtaacttttttcaaggttttttatctttttgcagggatagccgctgcattcaaaacaataagacagccctttatccctgacacaatcttttatcgcgcatttacggcaatgttccggcttgcctatatcgctgtttaagcagccggcgcatggctttttatgatagcaatgtttatagcagaccatgcagttcatgccgcagggggcgaacattatagtgtcgatattctcttttggcattttcacggcccggcctccttgtcatcttactttttcttttattctaccacatttaaaatctcaatgcacatgaaagaatgaatatccccgttataccggtaaggaaataccggaatgtcaccagttttctctctgttgttagcgcatacatatttctttatcagccatagtacctcctgcgccggacaggagctgtctattgcgaatctccgggcacatgtcaccgacctcaacgataaccagcacgccctgcgcacaggtcaccgccttcaaaaaaggagcgggtgcaatagacgccccgctcctggtaaattcctcttatttcaaactgcctgattggatccgatcgccttcctgcagttttaaaatatccgccactttggcaaatgccctcaaaagagccggattgaactgtccgcactctcccgcctgtatcatttcgagagctttttcatggctgtatgccggtttgtagatacgttcactgacaagcgcatcatagcagtcagccaaagcaaccacctgggcccatatcgggatctcgtctcccttcaggccatccggatatccatggccgtcccacttctcatgatgccaccggcagatatcatggtaatatacgaatgaatccgaattcttcaagatttcgacgttctccagaatctcgcatcctcttaccgtatgcagtttcatgatctcaaactcttccgccgtcagcttccccggcttattcaaaatataatcgggaatggcaatcttacccacatcatgcatggccgatgccactgaaatctcctcaattgtggccgccgggaaacggtacgtcggatccgcctctccgagagcctgcatcagtatcttagtggccgtcctgattcttttaacatgcccacccgattcacagtccctgaactctatgaccgtactcagggtatcaaccattgcaaggctggtctcccgcagcttctcggactgctctttaatcttcctcgtctggccttcgataatgctctccatacggagacgccgctcgtaaagctctatcgtattcttcacacgccgtctgattatacttgggttgaacggtttgttaatcacatcatccacgcccatatcatagcctttattaataatctcatcggaatcctccgcagtgattaaaaataccggatatttttcattattatggtgccgttttaattccctcagcacgccaaagccgtccagctccggcatcacaatatcaagcagtatgatagcaatccgatcaccatattttttaattgcctccaaagcctgcaaaccgttctccgcttccgccacacagtagctctgaaagaatagttcttttaaaatagccctgttcaactctatatcatcgacgatcaagatgactttacgcagatcctccatcctgctttcccccgtttactgttagaattaaaattatcttttagtccagcctgccgacgcactccagtactttgttatactcttttgccaatacgttaaagagcgccggaactttttcaaattcctgttccctggctgcagagactatcgacgccgcatctctgctgagctgttcaaagcccaggttagctgcaactcccttcaaggtatgggcgtacatttcaattcctttataatcctgcgaatcaatgcttgtattaagccgctgaaatgtctcatcatcagagaacttccccgcaaaacgtttccaaaggccctcattacctgcaaatctggctaaaactgtttcggcgtcgccatccagtatatcaaaaacatcataaatattcatttattatctgcctttctaagtcacatatacagagactgtcaatgtactcattttcttatttttgattgtagcaaaaatagaaataatttgcaatgactttaaaggcccacttccttgtcatatgcgtgcatttttgttacaattactttcatggaaaagcgaattgattatgaaataaaagagaacgactgcggcaaaacaatcgagtcatatttgagagaacgcggatattcaagaaagattctggttcacctgagacagacaaatctgggaattaccgttgcaggcgagctggcctataccaccagagtattaaaagaagggaatattctgtccgtccgcctgtccgaagaaacctcatctgagcgtattattcccgtacccatggagctttccgttctctatgaggacgaagatttgatggtaataaataaagcggccgggatgcccgtccatccctcccagggcaatttcgacaacacgctggccaacggactggcatggtattttaaagagaagggcgaggcctttgtgttccgcgccgtcaaccggctggaccgggataccaccgggctgctgctgattgccaaaaatatgctgagcggcgcgatcctttcctccatggtttctgaaaaaacaatccgccgggagtacagggccattgtctcaggcctgacagaagaggagggctgtatctgccggccaatcgccagagcggaaggctccaccatcgaacgctgcgtggatccggagaggggtgagtatgccagcacccgctaccgccggctcggctacgaccgcgataaagactgctccctgctccttatcacacttgacactggcaggacacatcaaattcgtgtgcatatgaaatatataggccaccctcttctgggtgatttcctctataatcctgattaccgttttataaagcggcagtcgctccactcctgccgccttacctttacacatcctctgacgggagaagcgatggactttaccgccccgctcccggaggatttctattttctaaggcccttaggataatggttcttaagaacgcctcctgccagctttgcccagccgcaggagtatccgtccaccgtcatcagagtccagcccttctggccgtcccctccggctgtgtccgttattgtttcccctctcagatatgcgtccgcttcccgggatacggccggataatcgcggtatccggccgcatcaccctttctcaaagccagcgccagtgcgtgggatggctcgaacctgtttttcttaaagctgcccaggtgaaggcccggcctgacaatcctgagcctgtcaatgcccggcatctcccccggtatccggtagagctgttctccgaaaagaatgaacgtctcctgctcagtccactcattcggctccgtgaggtattgattgcagaaatcataataatccttaagggcttttctgtccaggaaataggcaggataatttctcttatgctccctgtccgcgccgtcttttctgaggacggctataaaatggccttctcccctggtccggtgcggccagattctgaccgtattctctatccccgcagcagaaccgttcccccactccctgactcccgacgacagtccctcatagacaggcgtctcttctatggtaaattcaggatgtcctgcaataaatgtctccacggccatctcattctcctgcggcgcaaaggtgcaggtcgaatagaccagcctgccgcctgctttcagcatcctcgccgcattggcgagaatctcctgctggcgcagcgcgcaatgctctacattctctgtgctccactccctcacagcctcctcatccttacggaacatcccttcccctgaacagggagcatccactgcaatccgatcaaaaaattccggaaaatactccgccagacggccggagtcttcattcgtcaccaccgcattgcggactcccatccgctccacattctgggacaggattctggctctggccggatgaatctcgttgcttaagaggaatccttttccctgcagcctggaagcaatctgggtcgtctttccccccggagccgcgcagagatccagcaccttctctcccggctgcggatccaaaaagctaactactgccatcgcgctcggctcctggatataatatacgcccgcctcatggtatggatgacggcccggcctgtcctggggctgataataaaatcccgattccgcccagggaattggttccagcataaaagatgtcttagccagaaattcctccctgcctgtcttcagaagattcaggcgcagtccctgggaacgctccctgtcatagctttcaagaaattccccatattcatctcccagcatctgtttcattcgttccctgaacggcaacggcagttccatatcacacttctccttttatcatgattatttttcacagcattgccgctttttggcaagggtgtgaaaattaacttattgtatcacattccgttagttctgacaactttagcctgtgccgtttctgtgcatcgcaaagcgtgttactgttctcaccgcgccgctttctgccgaggtgagaacagtaacagatacatatacaggaagcaacacggagataataagtccagagcgtgtctgaaaattgctttctgtcggcagtgcgtcacactttatggcagatttggcccgaatgaattttaagacacgctctggctttggaggtgacatcatggtttcagtttttttttcgtatattattatcccgctttctacctttatgctggcccgcggaaccggttatttttccacaaatttttcttcaatccgcacgtccttatccagacagggcgaatttcttctgtggagtattttaaccggaacatatttctttttttcactccgttttattcttttccaggcaaaaaagcagttcgatataagaaaagagcttgtgctgctttacctctccgccggtatgatgtttgcctttgtggccacgccgtacctgcctgcccgttttcctcttttatccgcgctgcacgtgttcagcgctctgctttccaccgtagtcctgtttttctgccttctttttctggcatttaaactgtactggaccgcccccggaaaagggcgtccctgcctgcttctcttaatcgccacggctgttttttgcatttcttcctttattctctcaggaattatcaatacagccatggaaatctcgtttgtgctggcctgctgcctgctgatacggctctatctgcgcctgttttgcttggagcgcggcccagacaggaagcgcctctaagatttctcgttcaataacaaaagcccggacgcttctcgggcttttgaatgaaccttatacatttattgatcgctctcattggcgctcaaagcggaacggcttatacagcgactgtccgcctacgcatagaccaccacggaaatcaggataaacacgacctgcagaaccatcatgatgcagaataaaggcgtcataaacttataccatttgttgatcggcactcccatcagcccgcactccagcgcgcaggcagtcggccagaacatgttggagaagccgtcgccgaaatgataggccagcacggctgtctggcggctcactcccacaatatcggcgaccggagtcataatcggcatcgtaatggtcgcctggctggaggagcctgtgatgaagaagttaattacattctggattgccagcatcccggctgccgagaaatactggctgtgaccgttcagaagctgtgaaagatagtatacaatcgtatctgaaatcatcgcatcctgcatggtcaggagaatccctctggtgaaacccacgacaagcattgaggataccatactctgagtggatttgataaaggttttgcaaatcttcgtggccccgtagccgccaacaactccggtgatgatcatcatcatcaggaacatggctgcgatttcatcgatgtaccaccccagcttcatcgtgccgtagagcagaaaaccgatggtaaagacaaaaaggctcaggcagattttctgccggacagtcattgccccctcctccgcctcatgcacgggaagcgtatccagcttttccccaaaaagcaccgatttttccggatgggcctttacccttctcgcataccacataacatagaggatggacaccgtctgaaaaactgcaaaaataacgacgcggtagccaaggcctgagaacatcggcactccggcaatgctctgtgcgattccgatggaaaagggattcgtcgtggcggctgcaaatccggtcgcaattcccacaaatacgattgcgcccccaaccaccacatcatatcccagagctgccgctatcccgacaaagacgggtaccattccgtatacctcttcgtaaatccccatggtcgagccgagaatcccgaaggccagcatactgaccgggataatcagatatgtgcggctgcccatggctttaatcagacagttgatcagactgctcagcgtaccgttgtcaatcagcacgtagacatatccataggcaaatataatcaggaacaggatattcgccgcgctgacataccccctctggagcgccaggaaaatatcaaagaagcccggcctgaccccttgcgtaaaatgaaatgattcgggtattacaatcattttattgctcaccggatcaaggatcctgtcgtactcccccgcaggtataatataagtgagcgccaccaccgtcaaaagaatcatcgtaagaatcacataggtgtgcggcatcttgatgttctgtattttgtcttttaattttcccattttgcctcccccttgttttcgtgcggctgcgtacgaaaacacctcgcaggaaagtagctgaaagcagtaacttccccatatacgccagaaatccccggggaaaattccccgggttccggtcataaactccagtattctaaattgtcatatcctgtccttccaggaaaactttttccacttttgtatcgtaatcaaagggatgctttgaccagataacgatatcggcgtcgcggccggccataagctcgcctttccggtcatcaatccccagaacctccgccggatttttcgtaaccgctttcagtccttctatctcatcaagtcctgcgcgcaccgactgcgcagcgtatacggaaagatagtaaatcggtgttacgtcatgatccgcagtgatgcaaatcttgattcccgctttatttaacacgcccgccgtctcaaagcagcgtcccatgctctcaagcttggaccgcggatacatcgtcggccccaggatcaccggatagtcatgtttggagagaaaatccacgatggagattccgtccgtacagtggacaatgaccagcttcaaatcatactcctttgcaatcctgatcgcggtgcagacatcgtcggccctgtgtacatgcgcatggagcggaatctttttctccaacagcgggagcatgttttccatcccgatatccgtcctgaaatagcttccgtctttagccgcctcttcttttctgtgtttataatcaatggcgtcctcaatacattttctcagcagatacgcgttgcccatcctggtcttaaagctgtatccggccctctttggattctcgccaaagctgcattttacggccgcctttctttccagcaccatctcctccgcaacttttcccttgagtttaacgacactgcagatgccgcccaccacgctgtcgcttcccgggcagacacaggctgacgtcacaccggccttaactgccgtatccacggccagatcaaagggattgatgccgtcaattgtctcaagatatggcatcaccgcgtcgctgtaatcattacagtcgtcggcaatggcgcccatcccctcctcactgatacagatatggctgtgggcgtcaatcagcccgggagtgataaactttcctttcgcatcaactatctcttctccggcttcctccggggaaatcccttccgccaccttaataatttttccgtcctttaccaaaatatctcttttaacgaatccgccttcctcaaaaagcaggacctgtccatttttaataatcatagtctacctcattctctgatttatttgtaaccgttaaattactgtccacagccccgctgaaaagaacggttacatttattgatgacggtgacctgtgcgcagagcgtgcaggttatcgtttatcacttaatttttagcagtatccgatggctactgcgatcgtcataaagatgacctcaagcacaagcacgattccgaagaacggcgtaatgaatttgtaccatttgttgagcggtacgcccataagaccgcagtaaagggcgcaggaggtcggccagaacatatctgcaaagccgttgccaaactggtaagccagaaccgcaatctgcttgctcagtccaatcagctcggctgtcggagccataatcggcattgtgatggtcgcctggctggaagaacccgtaataaagaatttgataatattctgaaggaacagcatgccgtatgcagacacatacttgctggctccggaaagtaatgataccagataataaacgattgtatcggaaatcattccgtccttcatgacaatcaggattcctcttgtgaatcccacaatcagcatggaggaaaccatggcctttgtggattctataaatgttttgcagatatcggttgcagagtaaccgctcgctattcctgcaaaaatcatcatcatcaggaacatggccgcaatctcatcgatataccatcctaactgtgttgtaccgtagagcaggctgccaagtgttgcgaagaaaataagaagacagattttctgtcttgtattcattttagctccggtcagctcatccaggctctttctctggacgaattcactctccacaccgtacataatcgactttgtcggatcggcttttactttacgggcataattcatgatatagagaattgccgccaattcaaatacaaccagaattacaacgcgcaggcccagtcccgagaacatctccacaccggccacatcctgggcgataccaatcgtataggggttaaatgtacctgatgcgtatccgataatcacacccaggcagacaatcgcacctccgactacaatatcatatcccagcgccaccgaaattcctacgaaaaccggaaaaagaccgtaaacctcttcaaaaattccaagggtcgagcttaaagctccaagcacaatcatcgtaatcggaatcatgagctgaacctttttgcccaccagacgcaccagcgttcccagagccgcatccattgttccgttcttcaccagcatatagacaaagccgtatgcaaagataatcaggaacatgatattggcggcatccacatatccgcgctgcagtgaaaggaaaatgtcaaaaaatcccggcgccttgatatccacaaattcaaaacttcccggaactacgatcatctttccgctgaccgggtcttccactctctgatactgaccagccggaataatgtgggtgagaaccgtcataatcacaagtatcgttatcagtataacatacgtgtggggcatcttcacccgttcaaaccatttcttcttctctgttacttcattcatacttcattcctcctaaaattacaaaaatcgacatttctgttgttgctattataaagcttcaagtaacttgaatgtcaataggtttgagtgtataatagatttaacggaggttgggaggacgcgtccggaacggaccatgtccggtgtagtgggggctacctgagtcttccgtccccggtttggaggttgtcgtgacgggaaatccggccggaatgaatacttacggggaccgtttgcacttatggaagcgctgagtggcctcgacaaggtccgccccgcacttaacgcgtgagacattcagcggccgcaggccagcggacggggctgatacacctggctgagtctttcgtcccggagataaccttcctttggggcggaggagaagatatagtctgcggatgcctttggaatccatcgctgatttgcgaggttctgtcgagcttagcagcgtgatgcattccaccgagtgaaaacgtgctccgcagactatatcttctccgcagtcccaactcacaacaatctcccccccgggacgaaagactcataaaaccatcccgccgccccgtccgctggcctgcggcggcgtcctcacctgtttaactaaatctccacagaaaggaaccccatggaaaaatatctctcaatcggtgaagtttcacgcttactggacatccctgagtccacactccgcttctggcaggacaaaggaattttctctgttgaaaagggcgaaaataattacaggcagtacacggtctatgatttgaccaatatcgcagagattgccttctaccgcaaccttggaatgcccgtccggcagatgggacgttttaatcagttctgtcttgaagattatgacaaggttctcggttccgtcaaagacacactgcaggccaaaatagaaatgtataccgctatgtatgaatctgcctgtctgaaaagcgaacatatcaaaagcatacaatacttgaaaaccgtagactatacgtacgaaaaagttcccttcggcactcttgtccgctttgaatacagcgaccgtgagcagttgatccggtatacacaaaatccctctctttacgttcgtctgatggattcccgcgatccggagcatgataagaatgacatccggggaatcattgtttcttccgtccgggaacatgatacgctgatttggcagaaaaagaaagacagtctctatgccgtctttctgatagaggaaatcgcttccgaaaattatgtaaacgatatatccaaaaagctcggcacacttcagaaaaaacacaagacagggattctcctggccaatttcctgctgggagaaacggtggatggaaagcggattgattatctcaaagcatacgttgagattcttgattcctgatttataatttccacgacggcgtgatttttgaacgataacccgcacgctccgcgaacatgtcaccgttttcaagcaaaaaggtatgcactgttctgccgcagcagtcagtgcatacctcatattcaggtcattctctatgtcagttaaattttctagtatataatcttgtagttgtcagatccctcgccgttgattacgtaatatgcggtattttcttccggttttacataaatttcaacagtcttgatatctgtctctttgtgtcctgctgccacataagcttttttagccgctgcgacaagtttttccacttctgcttcttttcctgcgtactgtacatatacggcagttttaatttctttcttcacaggagcttttttagcaggcgcttttttagccggagcttctttcttgggtgcagcctctttcttcggcgcagccgccttctttggtgcagccgtcttcttcggtgcagcttccttctttggttcttcagcctttacttccggtgtcttcacaatttctttcacttccggcgcagcggcttccggtgctgcttcctttacctctgctacaggttttgcagtctcattaacaactgccgcctttgtctcagttttctttgttgctgccatctacttttcctcctcaaatcaacttataaacaaacttgctctgctgcattaatctgctgttgtcgattgagggaattataagcccaattttgctttttgtcaacctgggagagccttccattcgacaggcttgtccccaaaaagccttgaaaacactgtatttttatgtcactatccgcggacagctcccgtatttttatttaaatattactaaataaatctgccagaaccctgtcaaagtaacaataccaaccaaaattggcgtaatgtaacgaatcgctataatccagagctttttcagcttaaacggcacaccgtccctctctatttcgctgatcagatactccggatgccatttccagccaacatagtaacacatggtgagtcctcccagaggaagcaggatgttgtccgtaatgattccgaaaaaatcaaaaacactgtatttgagaattgtaatatctcccaatacgccaaaagagagcgcacttggaatcccaacaaggaaaatagtgctgccgattataaccgtggctttgcgccgggaccatctgagcgtgtcaattgcaaatgaaaccggaacctccagaagcgctatcgcgcttgttaccgccgcaaagaatacaagggcaaagaaaaggaatgcaaagatagggcctcctttaatttctgaaaacaccatcggcagtgtgccgaaaatcagccccggcccctgcttcggttcaagctggaacgaaaataccgccggaaaaatagcaattccggccagaatcgcaatcgccgtatcaagtcctgcgactgaaagacagctcttcggtatattctccttttcgctgagatagctgccgtaggtaattgtaatccccatgcacaggctgagcgaataaaatacctgtcccaaagctgcactgacagaacccaggctgaatccggaaccctccggtgaaaaaatgaatcggagtccttccgatgcgcctggaagcgtgacacttctcacaataattacaataaggaggacaaaaagcagaggcatcataaatttgctggccttctctatcccgctgatgccaaagaaacatatggcggttgtaattgccataaacacaaaatgccaaattacaggttcattgctgctgataaacatggtaaaatcggccggagccgctaaagtcgtgccataactgataatatattttataatccatccgccgataacgctgtaataactcagaatgacgaacgccgccatcacgccgaaaattccaacgatttttgcatgagggtcgatatcggcataggcctgtaccggatcatggcgcgtctttctgccgagagacatctccgtcatcattacgggaagtcccagaatcacaataaagaaaagataggctattaaaaacggaaagcctccgttccgccccatcagatacgggaatttccacagattaccgagaccgatagccgctcccgccgttgccatgataaagccgagcctgctggcccactgatttttcgcttgcataaattatgtcctcatactttctctgttaatagtatttccatgtcaccggtgtctcttcttaataaagatgaataccagtccgctgacccccatcagaatcggatagaagcaatatggtattatgtcaaagggagtcaggcccgtcaggctggccgccgccagaagctgggctccgtatggaatcagcccctgtcccatggagctgaacatatccagaagggatgccgctctcctgggcgtcacaccgaaatcattgctgatttctttggcgatcggtccggccataacgatagcaaccgtattattggccgtacacatatctaccagcagggacagagcggcaatccccagttccccgcctttttcgctgctgattcgttttcttataaaagacagaacaaaatctattcccccgtattctttaacgagagccacaatgcaggctacaatcatggaaataaccgtgatatcatacattcccataattccgtctccgacatgtacgaacatctcagcagctccaaaagctcctgtggcaagacccacaatcagtgacagcactgtccctgatatcaaaattatgaatacattgattccggccagcgcgccaatcaataccaccaggtaaggaagtaccttgaatatattataagacaaatctttcacaacataatcagtctttccacccaaaacgagaaaaataagcaccgtcacaatcgcggccggaagcacaatcatgaagttttcacggaatttatccttcatctcacatccctgcgttttaaccgcagcaatcgtcgtatcggagatcatggacaggttgtccccaaacatggccccgcccacaacggcccctgcacaaagcgccagcgaaaaacctgttttctcgctgatacctacggcaatcggtgcgagagccgtgattgtcccgacggaagttcccattgaaatagaaataaaacagccaatgacaaagagtcctgcaacagccattccggaaggcaggatagccagtcccagggccaccgtgctctccactccgcctgccgccttaaccgaaccggaaaaagcgccggccgccaggaagatcaggcacatggtgatgatgttctcatcccccactcctgcagccgccagcctgattttttcggcaaatttcagttcacggttctgtgcaaaggcaacgacaagcgctatcagaaatgcaacaatggcaggcatactgtaaaaatcgcctgtaatgaatcccgatccgagaaagattaaaagaaacacaataataggaagaagcgctgacgccctcccctttttttcattttgactcatgatgatccccctgttattagtattagatgatatatctgccataaccagacattatagttcattattatatacgatttttggatttgtttcaatatggagatttaactgaggttgggaggacgcgtccggaacggaccatgtccggtgtggtgaggggggctggctgagtcttccgtcccttgggtaggttggtcgtgaagggggaatccggccggaatgaattgctgcggggaccgtttgcactctttggagtgcgcagcagtgctaagctcgtgagggacctcgccaagcaccggcggactcccatgtcccctccgcaattgattccgcctacttccccggggcagattttcgccagggacggaagactcaggcggaggttttcgcggcaccggacatagtccgttccgggcgctgattgtctctaaccttaaatggggaggaccctgtcgacacggaagcactgagtggcctcgacaaggtccgccccccgcacttaacgcgtgagacactcagcggccgcaggccagcggacggggctgatacacccggcggagtctttcgttccggcgaaaaccttccgggagaaggagatactgccgacatcttccggcggagccggagagaatgatatccggaaggacgttcgcccgagagagggatagctctaagacagagggagacaaagcgcgccgggcggattttagccctacaagggcaaaatccggggcaacttgagcttcgaactcattcggagttcggagcgaatttgtccgtaaccccggagggctttgccttcctctgtcttagagctatccctcgaagaagcagtccagccggatatcattctctccggctccgccctgcgaaaacaaaaccacagtatctccttctccatccagcgatgccaaccccccgggacgaaagactcatatacacacctcaccaccccgtccaccggccgtaccggcggcgtcctcacctgcttaactaaacatttatgaacgtcttcccctttctcccatataataatatataaaaagcaagcgaggtatcagatatatggaaacctacaactacgatgattctgccgccatgcccggttatgacacagaaacttcagctaccccatctgttcctgaaaccggaaacagcaatgatgtaccggcggctcccggcttcggtcccgaaggtcctgtaacaccgtctgttccaacgaatccagccgattcgaatgttccggccactcccggatttggcccgtccggctccgttacgcctaccgttccgagcagcggcatgaatgttccggcaactcccgggttcggtccgcttggccctgtaacgccttctgttccgagcaacggcatgaatgttccggcaactcccgggttcggtccgcttggccctgtgacaccttctctcccgtcttctaactctaatatgggatgtgtcaactgcaccggaaacatcatttggccaaattcttctaccggaatcctatggacctggggaacactctctccatttttctcaacaacttccgatatcgcccatgtccgcttctacaatgcggcagctatacgtgagcctcttgacatttacttaaacggtcgccttgtcgtatcaaatctggattacatgaattacacaagataccttcatatcattccaggcgtatacaggctgacggtattcagaagaaccaatcctggtgttccgattattgataccggtgtacagttccgcggcggcaacagctataccctgacgatcctcggaacagccaacagctactccgtacaggtaatgacttcataaaagccaggaatcccggttatcttctgtcaccgccatttatcggcaaaaacaggcagccctcctgctgtttcagggggctgcctgttttcacctgcattaaaataactatcttttagtcctttttcatcatttttgttttttcagtcacatgcttttttatcgctgcaaagctttccgaactcacgacatgttcgattcggcaggcatcttctaccgccgtttccctgttaacgccgagagccaccagcaattcggtcagcatcgtatgacgctcataaatcgtctctgcaatctcacgtcccgatggctccagagtgatatatccctcgtgatccatggaaatatatccgttttccctcaggtttttcattgcaatactgacacttggcttggaaaatcccagctcattgacaatatcgatggaacgtatcatcggtttgcgtctgcttaaaacaagtattgtctccagataatcctctgctgactgttgtatcttcaaaataacctctcctcttactctataatctccgccgcaggtccctgtggtacattctgcttccccggactgccggtatcgcttcccgggccggaaggtactgtctcagggggcgcttcttcctgggaaggcagctctgcaggcggcaggacaggcggtggtgtctgggctcccgtgccgttgcttccggatgaattcagtattcccgtcatcctgtttctcaatgtatctccggttatctggttaatcagcgcctgggcttccgccttaaactgctttttcgctccggatcctgattttctcatctgatcaatcaattcctgagccgcatccgccagagcgtgatcctttcggaaatcccctaccgtatatccgtctgagagaagctcgtcgtcatccctgccgggcagatactggctgccgtcaccgattccggtttccggaccgggctccgtgaaggatgccggctctaagccctctaccagctgttccatagtcttcttccagatggaagccggataagtggcaccgtaaaggtttgacagcatcttcggctggtcgtagcctacccatacggaaatcgtataatacggggtcatgccgcagaaccatccgtctttactgctgttggtggttccagtctttcctgctgcttcaatgctgcttctccagcccatcgaggcggccgttcccctggaaattacgccttttaaaatatctgtcattacgttggccgtattttcctgatatacctgaatgacaggatactcttcgaaaacattgttgccttcgttatcgagcatcttaacgatacaggtcggttctttatagcgcccgctgtctgccagcgccgagtaagcgcccgccatctcttccgtcgtcgctccgtaggtgaagccgcccagggcggaagccggatagtaatcatcaggcacaatattgtcaaaccgcatctgtgtcagataggacattccaagttcaggcgttatatcatcgtatacataccatgcaacgccgttgcggctcttctccaccgccgtcctcagtgtcatcatatctcccggcagatccttcaccacagcatccttctgtttggcatcctgaaccttgatattcttcaccatcgtcgtggatttgtaaccgttctccagcgccggggcgtaaacgatcagcggtttgatagtgctgcccggctggcggaagctctggaatgcgcggttcagcgtatacgtatccgtatcctggctgcggccgcccacgatagccacgacccggttggtgctgttgtcaatcacagtcgcggcgccctgtaaagagaaaattccattttcggccaccgcctcgtcgaatgtcaggacactgtccaccgactcctgcagaattctctgtttgtccggttccagggaagtgtaaatcgtataacctcccgtatagagattatcccgctcctggttgtaaacttcctcatacctgtctttgtattccagatattcgctcttatcctggaaaccatacttgaaatcaaatccatccatcctcatcagatagcggatcgcacaatcgatggcataggtcgtctcataattcctcatcggcgtcttcatccgctgcacattgatggtttcctcaagcgcctgcgaatattctttttcggtaataaatcccatatccttcatatcaccgaggattttatctcttctcttaatggcattctccggatgcttataaggattgtagtaggacggtgagttcgggatcgcgcacagatatgctatctggctgaggcttaaatcatttgcatccacgccgaagtatcccctggctgccgcctgcagtccgtaatacgtattggcaaagctgatatcattgatataaaattccatgatctgttttttggtatacttcttcgtcagatccatggcaatcagcatctccttggcctttcgttcaatcgacacttccctggtcaggaaccggttcctggcaagctgctgtgtaattgtgctggcgccatgcttttcttcgccctcggttttgaaataattgatggcgacacggaaaattcctttaatgtcaattcccgagttgtcccaaaatgttctgtcctctatggctataaatgcgttcaccgcatactccggtatctcatcataggtcagatagctggaatcctcatcgccggtcagcttagcaagaacctcgccgttcgcgtcatagatgaagctggcctcctgcagccggaacgtgtcgggcgtgctggcctccacaatcccttccacctgtgtcttatactcgagatacatcggatagaccttataagcccctattcccagaactgccaccagcgcaatgacacatatgataaaaagtgtcatgaatgtaactttcagcaccttgaacatcgatctgaatataatcttgatgtatttccacagaccttttgaattatccggtttcttttgtttttctgcttttttcacttttctctgctgcttcttttcctgtttttgtgattttctgcttctcggctttctctgatgaagctgctcgtccggttcttggttccggacatcctccggttcattctgcatattggttcctgtatggcttaccagggaagatgcttcgtggttttctgccggcgtctcatcccggccgtccgccgatacttcggattcttgttccggttcattcgaagccgtattttccggcgtcttctccggctgacccatcagttctgcttccggctggtcccccggttgattttccggcatattttctgttgtcaattcctgtgtatcatccagtatgccttcctgtctaccttccatttcataccccttttgtcatcagtatatttctattactgtttatggctttccataccttaatcgtgccgcaaacagtaacatatttctgccgcaggcagagtatgtctcctactattataggagatttcccattaaagaacaaccattaattccaaaacttacttctgtaaccgcctgttttttcacgaatagtataaaataacagtaatttttggaaggaactatccatgaatacctcctttccccagctttttctgctcattaccgccctgtcgctggacgcctttgccgccagctttgtctatggaactgaccgcgtaaaaatcccggctgcctcagtagctgtcattacagccctgtccaccgggattctcgttctctttcttctgctgggcaaatggttcggagggctgattcctcccagggccacctctgttctctgttttctgattctctttgcacttggttttatcaagctttttgacagcacgataaaatcatttatcaggaaatcagatttttttgaacgcaaggtttgtttttcaatttctaatttgaatttcatcctgacggtttacgctgatccgtcggctgccaacggggaagacattgccgtcctctcacctgtggaagccctgtcccttggcctggccctgtccttagacagcgcggcggccggatttggagcaggcatgatggtcactcatctgcccctcaccatccttctgtcccttttacttaataccgccgcagttcttctcggaagcttcctcggccggacgctggcgaagcgctccagtctggatttatcctggctcagcggcctgctgctgatgggattagccctaggcaagcttttatgaccctgctgtgccgcaaagctgtctatgctatctctttgttgtggtttttaccaacgcaattacttcatgcgccagcagcgggacggccgccagcagcagcaggaacccccactcgcccggtgaaaggactgccgttctgaaggcatcgactaaaaacggaatctccgtaacggcaaactgcaggcagagcccggctgcaaatgccacagccatcagcgggttggtgaagagtccgcttctgaaaattgatacctccacgttgcgcatccccacggcatgaaaaagctccgataatccaagcacagtgaacgcataagtctgcgcccggcagagcaccgcttcttcccttagaaccgcggaaacagccgtcaaagagaattcaactcctcttccggtcaccacttcccagggtacacggaaaaatgccgcaaggctgattgctgctatcagcagtccgtaaaataccgtatagaaccatcctcctcctgcaaacagactctctcccggctttctgggcggttttttcatcagcaggctgccgtcatttttatccacccccagagcaagggccgggagtgaatctgtaatcagattaatccacagaatatgactcgatttcagcggcgaggggatacctgccgcgatggctgcaaacatagtggctatctccccgaaattggaggaaagcagaaaaataaccgacttctttatattttcataaattcctcttccttcttcaatagccctctcgattgttgcaaaattatcatccgtcagtatcatatccgatgcctgcctggccacgtccgtacccgtctttcccattgctattccgatatcggcgctctttaacgacggagcgtcatttacgccatccccggtcatagccgtgatgttaccgtcggattttaacgcccggacaattcttaccttatgatccggggacacccgggcaaatacagccgcattccgtatccgttttttcagctccccgtcatccatccgctccagttccgcgccggatatgcactgccccttctcctcggcaataccgagctgccttgctatggcgaaagccgtgtccacatgatcccctgttatcatcacggttcttaccgacgcccttttaaatgcttcaacagcagcttttgcctcgtccctcggcggatcaatcattcctgccattccaaggaaaacaagatttttctctgtcggcttcgtcaccccctccgccatggctccggccagaacacgcagggcccgtcccgacatcgtctctatggcctcctggattttctttctgtccctgccttcgaggggctgcacttttccatccttcataatagaggtgcagcgtttcaggacctcgtccggagcgccttttgtataagagacatatgacttgccttccctgttgagggttgtcatcatcttccggtcggaatcaaaggaaagttccgcatatctgggtttctccctttcttccctctctttcctgataccgcccgtaccggccagccggattagcgagatttccgtcggatcgcccgtttcctccgtcgcatcattgcacagacagaagcaggtcagaagccggtttcctgttttcccatattcaatcgccggggcttccctgattcttccgtccagatagcaggccgttaccgtcatttcattttttgtgagcgttcccgttttatcggaacacaccacactgacagcgcccaatgtctcgaccgacggaagccgtcttacaatggtccccgcctttaccattctcgtcacactgagggccagtacaatggtgactaccgccggaagtccttccggcactgccgccacggccagggagattgccgtgatgagcatctccatcacatctcttttctgcaccactgcaagtacaaacagcagggcgcacagaaataccgccgtaaggctcagcacctttcccaaatccgaaagtcgtttctgcagcggcgtctcctcctccggagcctcatgaatcagcgcggcaatcctgccgatttccgtagccatgcctgtagccgttacgattccgcagcccctgccgttcgttacgtaggaagtcatgaacgccatattcttcctgtccccgacctgaacctccgatgcggcaacaaaggtactgctctttgaaacaggtaccgattcccccgtcagggcggattcctctattttcaggtttgccccctgaacaagacgaagatcggcaggcacctgacgtccggcatccagaaccaccagatcccccggcaccagttcctctgcgggcactgtcatctccctgcctccacggatcacaaccgcttccagctttgtcatctttctcagggattccagcgccttttccgcctttccctcctgtatcacccctaccacggcattcattgccaccacagccagtataatcacagcgtcactgtactcatgaagcataatggaaattcctgccgccgcaaacaggacaaaaatcagggaatcacagagctgttccgcaaatctctgtgccagtgtttttttcttcgcctccctcagcatattttttccataatgttccagccggatgccggcctcttcctgagtaagacctgtccggccattgcattcaaattgtctgcaaacttcttctattgttttgttttcgtacatcttattctcccttcctccctgtgacaggttgtcttatagcagcagttctgacagcatgaactgttacgtcttatggaacaatatgacaaaacaataagaaatagaacttgccgttacgattcacggctcaccggcctgtgagtgtataggtcatctccttcaacaaaaacaggagagaacctccggccgcatccgggccttccctctctcctgttttccggacctcggtccggccttccgttaacattgaaacaactgaagctccgggcctgttcctgcctatgaatggttcccggcacagccctgcttatcttcattgcagtgattgctaccgcagtcatgtccatcctcgtgatgatgactgcatgatgtgtccggattataatccaggctgcctgcaagcagcttgtccacactctcatccgctactcccgtgacacccggataaaggcggattcccagttcatcaagtgctgcccgtgcgccggcgccgataccgccgcagatgagggtgtccactccatgctccttcaaaaatcctgcgagtgccccgtgtccgctctctcctgtactgtaaacccgggaggatatcaccgtatctttttccgtctcataaatcttgaattccccgcaatggccgaaatgctgaaaaacctgtccgtcctcataagttaccgctattttcatcattacatacctccaaaaacatttttatacctgatttgcaaactgtcatctgcagaccggcacttctttagtctactctcgtttttgtcatatgtcaataatcacttgtgcagtcaccacattgcctgtttttcttctcacagcaattttcacacccgcttcggcggcactcctttttacagcatccggccgaatggggacagagttcataggcgcctccgctgatacagagccttttgccgtccaccagcacctgtgccagctttttcctggctgaatcataaatattctggaccgtagtcctggcgacgttcatctgagccgcacaatcctcctgggacagccccagccggtcaatcagacggacagcttcaaactcatccattgtcatcgtaaccgtgccctccgctttcccgtcacccggaataaattccgttacctccggcagacagcaaatccttcttcgttttaccggccgcgccatccataccgcctcctaccgttcctttttacaaaataccgcagaacagcgctcagccattctgcggtaccctattacttaaaatttctgattattcttcaactgttgcgtacataaagtaccagtatccgtatggagaatgccaggttccctttaatttcgggctctgtacccagaagtcattctcataggcaacaggtgccatagccgtatcctctaacagcatattctctgcttcatgaagcagtttgtagtgttcttctttgtctgctgttgtacgcgctttttcaaccagggcgtcaaactcaggattgctgtatttaccgtcgttgtttccgttgtttgtctctaacaggttgatcatgttggaaggatcatcgtagtcatatacccagccgttacgtgcaatctcgaagtcaccgttacggcgtgtcggtgtgaatgtggaccactcaacgatcttgatatctgtattgattccaagctctttccatgcgctctgtaaatactcggcgattggtttgtggtattttgcatcatttgtcatgtactctaccgtcgggaatccctgtccgtccggatagccggcttctgcaagaagctgttttgccttctcgaggtccgcttcgtaattatcaacgttaaagaagtcgccgccgttgttttctctggtcacttcctcgaaggaggatcccggcgcggcatcagagatgccagggcctacaaagttagtagccggggaatatgttccctgagttactgtctctgcaatgtatttacggtcgatggcaaggcttaaagcttcgcgcactttctcgttgtcaaatggtgctttctgaaggttgaaggagatgtagtaggttcccatgatcggagcgatatggaaatcttccgtacccatcaggcttggaacttcctcggaaggaatatcttttgccatcatgatctcacctgtcttatatgcactgtaggaagcatttgcatcctccatcaggacaaatttcaccgtattgaccgtaactttctcagcatcccagtagtatgggtttttctcgtaaaggatataggatcccggaacccactctttcattctcagagcgccgtttcctacatatgtttcagggttgattgcccactgatcgccgtttgcctcaatgatgtctttctttacagggcttaatacggcaaaagcggaaattttatcataatatacgcatgggtttgcaagctctacaacaaatgtttttgcatccggagcagatacggcaagtccatccactgctgccagtgtctcttcctctgttgcgtcttctcctaaattcaggattgcatcatagcctttcaccatgcagagcatgtcataggcatatggagctgctgtcagcggatttgcaagacgtttgtaagaatatacaaaatcctcagccgtcagatcggaaccgtcgctccattttaatccgtcacgcagatggaatgtataggttaaaccgtcatctgatacctcaaatgattccgcctgtcccggaacaacgttgttctcctcgtcaaaggtgagcaatgtctcaaatccgtgaataatcatgttggctccgtcgattgcggagtttaaggccgggtcaagtgtctccggatccggtccaatctggactgcaaggtctaagccccccgctgtctcacctgctgctgttgttgtgccctgttcgcttcccttgctctcatcggttcccttggaaccgccgccgcagcctgcaagaactgtggtggaaagcatcgctgctgctacgagtagtgctacttttttcttcataatatcctcctttggatttttattttaaccggccgcctgcctgatgcaggcagccggctaagtgcatatcaatgacaaagtcaattcacccgatccaggtgatggcaggccgcataatggcccttcgacacttcctgccatgccggcgtttctgccgcacatctctcatcggcataaggacatctcgttctgaaccggcagccggacggcggattaaccgggcttgggacatcaccgcttaatacaattcgtttagactgtctgctggttctcggatctgcaatcggaatagcggaaatcaggctccttgtatatggatgcacactgtggaaggtcaattcatagctgtctgccagctccaccagatttcccaggtacataactccgattcggttggaaatgtgctttacaattgagaggtcatgggcgataaagagatacgttaagcccatctgctcctgaagctcttcgaacatattgaccacctgtgcctggatagatacgtccagagccgaaaccggctcatcacacacgatgaattccggatcgacagccagtgcacgggcaatgccgacacgctgcctctggccgcctgagaactcgtgaggatatcggtttgcatgctcggagttcagccctacgcggcgcagcatctcaataatcttatcctgcctgtcctgtttgccgaacgccagtttatggatatcaattgcctcaccgacaatatcacctaccgtcatacggggatccaggctcgcatatgggtcctggaatacaatctgcattttccggcggtaaggcagcatattaaccgccgtcttttttccgaacaccggttttccatcggccgtccggggctttccgtcttccccgtaaagcggcacgtcgccgctgtcaaatattgtctcgccatcatagatgatccggccgctggtcggttcatggaggcgcagaagggaacggcccgtggtcgtctttccgcagcccgactctcctaccagtccgagcgtctctcccttattaagaaagaaggagacattatcgaccgcctttaccactttcttttcaaacatcttgccgccggcaacagggaaatactgtttcaggttctggacctcgactaatttcttatcttccatcaaatcttacctccctgtgctttctcaaattccgccttctgaaggagccagcaggcgctgtaatgaatatccgaaatgtcggtatattccggcatttggcgcaggcagatcttcatacaggaatcacatctcggtgcgaacggacatcctgccggaggattcagcatatcgaccggacttccctcaatcgggacaaggcggctgtgctctttctcgttcagcttcgggatgcttctcagaagtccctttgtatattcatgggacggattatagaagatatcctccgtcgttccatattcaactacttttccggcatacatgacggcaatcctgtcacacatgctggccacaacgccgaggtcgtgtgtaatcatgataatcgccatgccgagtttttccttcagttccatcatcagctccagaatctgggcctggatggtaacatcgagggcagtggtcggctcgtcggcaatcagaagcttcggttcgcaggccagagcaatggcaatcataacacgctggcgcataccgcccgaaagctcatggggatactgcttcagcctcttctccggctcgttgatgcctaccagggtcagaagctcttttgccctctccctcgcctcctgcttcgatttatttgtgtgaagaagaatcatttcacaaatctggttcccgattgtatatacgggattcaggcttgtcatcggatcctggaaaatgatggaaatctcctcaccgcggatctttctcatctggttttcagtcatctcatcaatccggtgtccgttgaattccagggttccccctatcaatttaccgggataagcggtcagtcccatcaggctgtacgcggtaacagatttaccggagccagattctcctacgatacccaggacctccccttccttcagatggatggaaacatcatttaacgcctttacctcaccggccggtgtgaagaaagagaggcgttcattcttaatatctactaaatattcgctcattctctattcctcctagttcttcatcttagggtcaaaggcatcgcgcagtccgtcgcctaacaggttaaagctcagaataatgacggaaatcattatcgccggagcaaacaggcggtgcggatagctctgaagaccgttaatagcggcgctggcaaggctgcccagggacggcatcggcgcattaacgcccagtcccaggaagcttaagaaactctccgtaaaaatggatgacggaatctgcagcgtcgttgtaacgattaatgtaccgatacagtttgttaacagatgttttctgataatcctgccgctggaagcgccgagagccctggccgccgtcacatactcctgctctttcaaaatcatgatctggcttcgcacgatacgggccataccaacccagtaaagaagggcgaataccagaaaaatactgatcaggttaacaccgattacaccgatccattcaaatcccggcttctgcgacaaatccttcagcggataattcagcacggcagccagcagaatgatgatcagaacatcgggaaccgtatatatgatatcgacaatacgcatcatcaccatatcgacccatccgccgaaaaatccggagattgagccatacagagaaccaatcagcagaatgatggccgacgccaccagaccgaccagcagggatacccggcttcccatcatgacgcggactgcgtagtcgcgtcccaggttatcggttcccagaatatgaggaaataccttctctcccgcttcaatctgagccagctccgtctcggaatactgcatcggcgccaggtttacgctcgttttaatctgctgttcatatttatatggataaaccgtcggtataacaaaagaaagtacgaagattaccagcacgacaatcaggctgaccatggcaatcttattctttttcaggcggcgcatgccgtccttccagaatccgacgctctctctcattacaacgaggctctgtttctcgctttcatctgccgggaggaaatcttcgacattcatctgaaatgataatttattcttgtccatcctgtgtgcctccctatttcagtttaatacgcggatcgatgatggtatataaaatatccacgaccacgttcatcgtaataatcaaagttgcaaggaatattgtggttcccataatcagaggatagtcacgccctgtgatggcgccgataaattcggaaccaaggcctgggattgtgaagatcttctcaacaataaagcttcccgtaaccgtgtacgcaagcagcggcccaagataagtaacaaccggcagaatggcatttctgagcgcgtgcttgaacacgctgaaaaaccatgccacgcctttcgccctggcggttctcatgtagtcctgtccaaggacatccagcatggaagaacgcatcagacgtgaaatgtaggaagccggatacagcgccagcgccgtcaccggcatgatataatgccgccacgaggtcagtccgtatgtaggcagccattccagctcgaatgacagtacatacattaacagcgtggaaataacaaaactgggcaccgcaattccgcaggtgctgaatatgataatgatattatccgtcatcttgcccctcttaaatgcagcaatgctgccaagggggacgcccaccagtacggctatcaggatggagattcctccaagctttgccgaaaccgggaattttgtctcaatgatggaattaaccgtacgtcctctctgttttacactcgggccaaggtcgccgtgaagcaccttccccatataaatggtatattgttccggcagtggtttgtccagcccgtatttttccatcattgcctgctgggcctggggtgtgagggccttctcagccataaacggaccgcccggtaccaggttcatcaggaaaaatgtaagagttgcgacaagccagcaggtaacaattgccagaccgattcgctttgcaatatattttgccatgatacctctcctttctgtatgtgaccatgccgaattttgtcctaaatttccatctatcattttccggtttttggaaataatggacactataaacacatttgtcaatctactgcggacattcaaacgataaaataaaatcccatggtggtattccatgggattttctgtttgccgttatcccgctatctagacattatgtcccggcttttatgttcattgccgcagcattgaccataaaaggaccataaaaattcatttttagtcacgtttcatagtataccatagtaattgacgaaatggcaatacgtttcccagtttttttacacgaaaaaaagcggaaatttttcctgccatttccgcttctttcctgtcatttctgcttctttcctgttaaatatttgctgattcctccatgattccctgaagacggctccaatcgttcatggaatatttcacggcaatatatcccaggtggtgatccttttccctaatcgcctggataaacaattcatggtgcagcagtacggaaaaatgattttcatagctttgctgctcataggagttcagtatgtaaggcctgaatatctctatcaggttcctgtaaacctcctgtaatacacggttttttgttatctccgtaatagtacggtgaaacttcatatcaagatccaccaggatttccagctctttattctcttctatggcctggtgaagctcattttccaccaggcatatccgttcgatgtcactttccgtagcggcgcttattgcctgtttaataatcccgacttcgagaatctctctcagactctgtaattcgacaaaatcggacccctgggaaatgatctggaaaaacagggcgtcaaacattccggcgcccgcagacgcgcatacatacgtaccgtcgccctggcgcacctccaaaattccgtatgattccagaattttgatcgcttccctcacgcagccccggcttttgttgaattttttactcagttccggttctgtcggcagcctgtctcccaccttcagttctttattgattatcatttttttaacggcagcaacaatttggtttacatatgatcctgatttttccacttttaccttttactcctaatttaatggtctcattatatcctgttttagcttaatatgcaatattttcagctccgtctccgacagcgttactattcacggcccggctaactgccggtcaggcccgtctccccgaatagcttcttcagatacaggatggactcctctgcccactcctcctcctttttcagggttttatccaggttatcttcagacggcatccagaattcaatgatcgtgctgaaatcctgctgcgcttccttaccgagcctctccagaatcatttccaccttctggcgtccccgtcctaccggggttcccactatctgcagccccacactgcccggactcctgactatcgtgtaatccttaaaatgaagacaaaccgtatactttgccagccaattcagcacctcttccaccgtttcctcctgtgacagggaattggtggtatctaagacaattccatagcggcggctgtccagccgttccattatataggcaaattcctctgccttaaaccggtcatggttctctattcccagaacgatatctttctcctccaggaccggaaggacacttttcagcgttattataatctcttccagatccggctcataaccattgtcatcgatcacacagcgcagcagctttgcatccagtttttctgcaatagcaatcattcttaacagatttcctcttgccgcccctctcattcccacttccagctttatcccgttctcctcagctttcctgcgtatatccgcaagctcctgcggcaggcagtgagctaacggactgttctcgcagatttgtacataatgaagattatatttcttcgccttctcaatcagttcacagggcggcattgcctgctttacggccagctccggtctgatcaggcctcccagtccgcagtgatagggataagtccaggagccgattcccagttgtgtccttctcttcttttctactgtcttttctttcaacgtctcttttcctctccttcttttccactgtctttttgccctgtctcccggcatgccttcatcgttacccaatcagctccggcagccacgtaataatctgcgggaaattgctgattaggattacaaagataatctccactatcaggaacggcactatcttcttacaaatattttctatcctgctgcccgagactctggatgcaatatagaggtttaccgccatcggcggagtaatcattccgacagatgtattgattaccataatgattcccagaaccagcgggctgattcccgccgcattcgcaatgggaagcagaatcggcgtcgtcagaagaataataacgctggtatccagaaagcatcccagaataagcaggatcatgttaattgcgagaaggatcataattcggctctcaaccgtgctgatgattgctgtggaaataattcccgggattccctgactcgtcataaaccaggcaaacggagccgaacaggcgcagacaatcagaatcgttcccgtactgataccggcccgttcgatacaattgccaagctccttccagctcagttccttataaacatatctgctgataataaatgcatagaacacggacactacgccggcctccgtcggagtaaagataccgccgtaaatacctcccagaataattaccggcatcatcaatgctccgagagcctctttaaaagctttgaaaccggttattccctgagcctccatctctgccctgaccgcatatttgtcacgcttgtccttcctcataatccacattgaggtcagacaaagaatcaaagccagcaggattccggggaccacacccccaatgaataaatccgtgacagataccgaggctgcaattccgaaaaccaccatcggaatggagggcggaatgattacgccaagtgttcccgaggcagccgcaatcgctcctgccacatcgtctggataaccgtcctttttcagttccgggcacatcatccctccgatagcagaaacagtcgccggattcgatccggaaattgcaccgaaaaacatggatgccaccgttgtgatacaggccagattggcaggcagccaccaaagcgctgctttgacgaactgcaccagcctttttgaaatacctcccttcagcatcagttcccccgccagcatgaaaaacggtactgccataaatacataattatcagcctgggtgaaaatccgctgtgccagaactaccatattggtgttcggctcaaaaatactgagcgcggcccaggatgacattgcaagggaaaaacaaattggaatgccaaagaagattgccccaaataaaacggcaaacaatacagccataatcattttgcctctccccccttctcatcctttcctgataccaaccggattgactctcgcagaacagcctgcaccactcctaaaatcattcctgccggaatcgatgcatacgcaatccacatcgggattttcagagtcggagacttctgccccatggccgcaatcttcatgcagcattccacaccgacctttgccagtatcagcataaacgcaacggtcgccaagacggcacatcccctgacaatccctctgatgcttgcaggcagtgcatcaacaaccgccgtcatcttgtaatgtccatcttcctgcatcaccagcgcggctcctataaaagccatccagatcatcagataacgggcaaattcttccgcccatatcaactgagcggtaaataaaccggtaatacgtgcaagtgtattgagaagaattatgatacacataatcggaagaaggattataatcaatgttttttctgtttttgcaagcgcgcctgcaattttctgaagaaattctttcatatcattctcctgtaacggtgaaagacatgtttaacatgcctttcaccggtccttctggtttaagatgctgcgttcctgctgtgatcaggatggctcctattcataaaaagcgttccagtattcggtatctatcccacctttatacttttcagccactttagcggaagcatccttccattcccgggtgtcaacctgggtaactgttacaccatattcatcccgagcgatctctgcaatctcatccattttttccattgccctgtttcgcataaatacggctgcatctttaccggcctgctgtacggccgcctgctgctgctccgtcagagagttaaacacatcttcattgatcaggaatacatatccggaaataatgtggcctgtcatggtcaggtacttggcagattcaaatgctccctgggtgtagaaggcatctagaatattatccatcccgtcgatggtcccctgcgccagcgcagtaaaagcctctgtggaagccatcgcaaccggattcgccccgatctcacggtagaattccagatgaatgtcgttttccatggtgcggattaccaggtttttagcatcagccggttttgtcacttctttttttccgttcagcatacagcggaatccctgatggctgatggcaaggccttttgtaccgattgaagagaggctgtccagcattttctgtccaatggctccatccataatcgcataggcatcttccagtttattcatatccaccatatatggaagatcccagatattaaaatcatccacaaagttggcaagaggagccgtcgagccggcatacatctctattgtacccatagaaacgccttcgatgacatctctctcatttcccatcgttccgtcataaaacacttccagcctcacggtcccgtccgttgccttcttcaggctctcgttaaacacttccagagcttcggccggaagggaattctgggatacggtaattccacagcgtatcacagccgcatctttgttgtctgccggttcctctgccttcggcgcctgacccgctgcaccattcgtgttttcctgctcctgattttcagtccggacggtttcagacgcagtgtctttctgtccgcatccgcttaatactccagccgtcattgctgcgcataacaataagctaatcgtttttttcataggttctcctctccttttgttttatcatttcctgctgttacctgcctgccgcagccgttatatcgagaatactcttcgtgacatattcctccgagaccatctcatccagccagccgtccctgaaaatctgattcattgaattttccagtgccaaaatcgctccatctgaaaatttggcatcaatcagcccgaacgtaattgccacctgcactctcaaatgccccatcagaaaagaaaacagtgcgtccttcggaacgccaagctccacaaatcggtcataggccagtttgattgcataaatcatcggagcaccgatggattccaccatcccgggctcgcacattcccatctgttcaaccgtgatacggaatgtctttcccaccggagcaaaaataatccggctgatcttctctccctcggcataatactcctcttctcttccctcaggcgccttgtaaacagcgcaggaacaatcctgggtgacaatacctccgaacagatccggttccccgttctcatccacttcagtattgaacaaatacgggtgatggggatgtaccacaaaatacgccagatcatcacggacaggcatgacgttggcataggctgccgccggatccagtcctacaaccatggctcccggcttcataataggaatgatttcaggcgaaagctttcctattaatatgtcgggaacagccagtaatactatgtccatttcaggcaccgcagtttccatcactgcgatatcttgaatccccagtccctcgagccttgcaataccggtctcgctgatttcgcaaaaataagattcatattcttcgctcgtccataattttctgctgacacgaaatcccattttcccgcccgcaccaataacaatcagttttttcttcatcgtatactctccctgtcttgtctcatttgaatcatccgatgtttcgccctatttaacgccggctgttaaactttcaacggcaaacatcttatgtttatatctttagcatatagaatcaattagcatttgtcaactataaaatgtctgtttttttatattttttgtttaatttatactctaaacttttattttatgcagccctatcagaataaacatcatatctttaaagaaacgtaggggattttatactataggaacatttcctcgtaatcgagtaggaggcggtgattaaccgccgtcctctcacaccaccgtgcgtaccgttcggtacacggcggtttcaacagttgacgtgcacagactgataagctatggctaaatcataaaagccactgcttatcagtctttcttttgtcattgccatatttaccgctaccgtttgcgtggtaaaccaatatcctctccggctgtttcctgcctgccatgccaaatcttccggcactcccattttccgcaggttcttcaccttggttctcggtttcttccattgtttccatatacacattcggattctgtggtatagccacttattgagttcttctattcggttcttcatttccgcaatcccgtaataattcagccagccacacatatacacttttatctttgctaatgcagggcgtatgctctgaactgaccttcgggaactaagttctttcagctttgacttcattttcttccatgactttccatgaacccggacatatatgccctttccgttctttcccaatgtaaagccaaggaatttaaaagttcggattgcaaacacgctgactacacggcttttctcttggttcactttcaatttcagcggcccttccagatatttcgtgctcgtctccagcagtctcttggcagctctctcgcttttcgccagcagcacgatgtcgtccgcgtaacggacaaatacaactccacgcttctgatactcctggtcaaactcattcagatagatgtttgccagcaggggggaaagatttcctccttgcggcgaaccttcttctgtttccatgactactccgttttccatcacgccactctttaagtacctcttaatccactggattaccctttcgtccctcacatttctgcgcaggatattcaggagtatctcatggttcagggtatcaaagtatttcgacaagtccaatgctaccgcatggatatatccccgctctgcatactctttcaccttctgaatggcatctttcgcgcttcttcccgggcgataaccgtaactgttctccgagaacaacggctcgtagaccggtgtaaggcgctgtgttatggcttgttggaaaatgcggtcttttacggttggaatacctagctttcgtattccgccgtctggcttgggaatctccactcgtcttaccgggtcgggggtgtactttccccttctgattctctcgataagttctttctggttttccctcaggtatgcgcctatttcctccacggtaatcccgtcgattcctggcgctcccttgtttgcctttactctcttaaaagctctgttgaggttgcccttctccagtatctcctccaagagttccggctgtgcactgtccctttccttccatatccggcggaaagaacggtgcgctctcacatacccttcacgttccgcgctatctctttgcgagcagctatctttgttttctgtacccaatgttctttcctcctttcccagttgtactaaagactcctgttgattcggtccttcatctctcgactactacgacctcggctgacttctgtacgttcagcactatctttcgataatggttatccctttcaggacattccgcacagacctccccgggtaccacacgtctctttctctccatctatctgccacatttaccatacgtgattccgtgtggttattgggcttcgacttgttcagcagccttaccctcacgcatggcctgatgtgatttctgtccgtcagaccagagatttgcccatgggttagtatgttccccacatccggcttccttcagatttcacctcacgatgaacacccttgccttcggctatatccttcccaccaccgggcggattccggactttcaccggttagagacgtgcgccgccgggcgcactgataaaaagcgcagccggcaagcagcatctgtttatcatgctgtttgccggctgcgctttgataacgctccgtcatttcttcttttttggccgtttatgcatcagaaatcaattcttcttccctcttcggcggactggtaggcggcatagataaccttggtggtttcataagccaggctgaatccggaagccggggcgcggtcataagccacagcctccatgaaatcctggagttcgcccatgtagccccggataatttcatcgttcacaaacgctttgttccatcccagcttagccggaagcatctcggatatttccacatcctcaagtccgtcttcgtccaggaaataggtattcaacagatcggtaggagtgatattgcaatttaaagcagtgttatttccatagatctctatgtagtttttcgtgcctccgagaacggtatcgctggctatacacaaagctttcgtcccatcggagaacgtcacgctgattacaccgtaatcctccacatcttcgggctgtgccgcaatatggcggtgttcatccccggtcaggcaccgggtggcacagcccacgtcacagctcacgctcttaaccgtgatctcctcatttcgggccgcggcctcctgctgcttgagccagagcataccgcccatcggatgggttccggtacgcatcagagtgccgccgcccgtcttattccatttgcctgccaccggactgctggagcctttcaggctctcctcgcccttcataaaaagcagctttgtctttttagcccggatgatctcagcggccttctgcaccggtgtggcataaacgaagttttctgcatacatgaacttcttaccggtcttttccaccacctctttcaggcggtccatctcggccaggcactggctaagcatctcactcttcggtaccgtaactccgatattctcctgtcccggccggccgaagtatccggtcagaggcttttcgcagataacatgcttgcctgcctccatggcctctatagcgatggatgtatgcaaaaaaggcggaagtacgatatcaatcacttcaatttcaggatcctccaacagcagacggtaatcgctgaccgcctgttcatagccgtagcgctccttcaccttttccgcaagcgggagattcagatcacagacagtctttagccggacagaaacgccgttcaccttctcgtagccgttaccatgcagataggcggcgtagcccgcacctacggttccaattactacagtttttgtttgaccacaactcataacttttccctcctgtcagctgataaatacctctcttaataaaataaggttttcgtcttcttcttgctgtttttattaacctttgatattattaagatagcacaggacgggaggtggaacaattgcgttccccgcctttattcataacatttcagttatgtatttatagtaaacgacaaaaaaattgccgtttactataagcctccggggggatgtacacgatttttgcaaggaagcttctgcgtttacacgcagcaaaaatcggcacaggaaacgtcataaggaaaagatttatgacgtttcctataatttatattgcgcatgaaaggaggacaggctttctgcctgcagcatattatgactcttcgtcaattacagcatttcgagaatctggcccgaacccagcactatcagcgttctgccgagctgctgggaatcagccagccggctctcagccgctcaatcagttccctggagcttgaacttggcgctcctctctttgaaaaacagggccggaatgtggtcttgaaccgtttcggacgtgtttttgcagaacatatttttaccgccatacatgaaattgacaccggtgccgctcatctccgggatatgaccgatccccggaaaggcgtaatcgaaatgtcgctgaactatgcaacctccaacatttatctcccccgcatattgcgcgcctacatggccggacgaaatcaggatgaactgaccttccagttccggcagtccaacaccccggccattttaaccgatgtgcgggaaggtatcagtgaacttggtctatgttcctatatggaggatcagcctgagatcctgctttacccggtggtccgctgcccgcttctcctgctggctcctccgggacatgctctggcccgcagagagcaggcgtcactccaggaaatcagccggtacccaatgattttttcagtcgataagactcactatatcgaaaacctgctccattctcagggcttggatcccatcatcgcctgccgtatgggggaggatcgctccatcgccaatctggtcgcctgcggctttggcctgtccgttcttccctacgatccacaactggaggcctgcggtatcgtatgggttcccatcagtgactcctgtgcctaccgtgaattctatctggcggtatcgcgcacccgcccgctctccgtccatgcacgcgatttctgccgttttatgctgaatgacgccgtacaaagcggggcgctgaagcagatgcctttccatatttaaccgtacgaaaaggcgcatccggagtattcaggcgttcgtcacagccgtcaccgcagtgttcttactatttgccgtgcattcaaaaaccaggcatcctccggattaacatacaggatatggttaattttcccaagcagcgacatcctgtacctctggattccggcttccccaaggggcagaaatctggtatcatgaattgcttccagatgagaacgaagtccaaaacgcccgcaataatgaagctcctgccgcagccgcctccggtactccttcgatagctggggcttctggtttaccacaatccccgtaacctcctgtctctgatgacaggataccgcctttgttttcttcgtattcagctcaaatcccatagcctttagaaatccgccggctttgcgtatcactgtatctgcatcgaactcacctgaaaatgacatatcgtcgcaataccggctgtagcggatccccttctccccgcaccaggctcccatatatgtgtcaaacggcttcattacaagattggatattgcggcggatgtcggcgctccctggggcagataatcacggtaacagcacagataagtcagaatcgttcccaccgacggcggaaaatagatggttggaaatgcctgttgatatacctgactgaacaggatattttcaaaaaaatctttaatatccagcttcagaagcagcttagccccgctgtgcggccgggcattgagccgtattcccgcccccttatggtatgccgttgcatatggggagaccggcatctgatcaagaatattgtgcaggatattgcgctgaatcttttttaaaagaggatcgggtaccagaagacggcggatgctcccatccctcttcctgatctcagccggatgataatgcttttctatatgattactgacagcataaaggcaggccagctgctccccgtcctccctgtcagtcctgccaagcagacgcaatgataagagaaattccctgctctgctccggcgtacaatatttccatagtcctgtattttccatacaatctctcccatgcaggaaccatacttaaaaagattcttcaatatgcgaagatgtaccggactgtggcaaagccacagaaagcacacaaagtgtgcggcgtaccttgcagcaaattgaagtctgcaggccctgcctgcgtctgactttgataaccgccggcggcgactcgccgccggcccaaagcggatgctttggctgcgctatggttcctgctgtttgatgtaatgccaatatcactatactagcatatctgctcctgattgcaagaaaaaagtatgaactgccggttattaattataaaactgccgaagtcacaacgcctatcacaaataaaggcagggagaatacaagcaccgccggaacggtcgagtcccatatatgatcgtgttgtccatccggattcagccctgatgtcggtcccaatgtcccgtcagatgccggagaacacacgtcaccaaccgctgccgccaccccgatcagactcgccgtgcccagggcagtataaccaagtgtcatacacataggcacatagatggcagagaggatgggaacggttccgaagcaggttccggttcccataacgatagtgaaaccaatcagaatcagcacggcggacgctataaatttcgatgcagacagcacatttgcagaaactgcaaccaaattttcgattccgtgcgttgccacaatcacctcggaaaagccgctggccgctaacataataaaagaaatccagccaatcattgctattccgctgttaatagtttcgtcaagctccgaatatttaaagcagcccgtaaccaccataatcaacagccctacaaggcctcctattacaagagaattgaaaatcagctgaataataaaggtagataaagcggcaaggattgcgccgatatgccgcctattcaaaacattttttccctccgctttatttcctgcatcagctcccgctataataatctccttatactccctcggttttctgtacaacaccagaacagcaaacagcagaccaagcagcattccaataccggccggaaatatcattgctttccaaatctccattgtctccatcggcattccgtatttcgtcatattgccggcaatcagatgatggaaaatcaatccgtaccccacaggcagaaacagatatggcgctctgttcccccagcagagtgcacaggcaactgcgcgcctgtcaatcttcatacgattcatcatatagataagcggcgggattaaaatcggcataaaagcaatattgacaggaattattgtaccggacaaactggagatacctgcaatgacagcgataaacaaaagtttttttccctcaaaaacacgctgcatcccatccgataaaattgacattaaccccgtttttgcaattcctactgcgatagcccccaaaaggatatatgacaatgctgtctctgagtttccggccatcccattcatgaatatagtcatagtttgatcaatcggcatcccggcagcaatccctcccaccatggatgaaatgataaggactaacagaacattcagctttaacaggcaaagcacacacatcagtacgacagaaataacgactggatttctgataatatctaacatagttcccctcctaataccaggcccataagagcctgccccataagttttaagtttattttgccccgactctaatgaccccatttaccgcgtcgagagttacaaggtccccgtccttgatttcactgaagaattccggatccaccttatgcaccatcggaatctccattgctaccgccgccgtcaccagcaccgtgtcggctgtctccacgattaatccggccgggtgcttccccttcatcagcagcttgtaaagaccatccgcctgcaccaccgaacttccttttcccgacggcatgatgagtatctttcccgccacattctttccatttatatcgtgattgcgttcaatcagctcccctgtctcaggtactacgagataaaagcagaccgcatctttggaaaccagagcctcggcctcggccgtcccttttgcaatttttgcgcagtgatatgtacgttccattatttaaccacctttcctgaaattgccgcctctaccgcttcttcgagcggacggattaagaatttaattccgcggatttcattgtaataagcacatttcggagaatccgtcactcccaccgacccgtaatacggtttccagcacggaggtacatcgatgcaggtatcggctattatatggccgccggccctctggatgatgttcagatatcccattctgtccgccagctctctcgtaagggaacttgtcagcagccatgtgtctaccttgaatttccttccctcacagactttagcaattattccaacctggcggattgtgatgtgggggcacccgaacatcgcaaaatcaatcgttcccggctcattgcaaagccgctctctcgtatcctgcaaatctttatccgtaatcacgatttcccgtttaatctttttgcttccgacggccgcctccacggtaggggcctccggtgtgattcccgctatgtgatacatggatacgcatcccgatgtattgagctgagcgccgaaattcatgaagccctccggcgtcggcctttctttaatccctttaaaaacaggaacctcaagtcctttatatttttccggataacaccagccgagaatctggtagtcaaaatccgttttaacatccgcctggacgtcaaccaggatttccgccttgcggttctcgtcgaatagaagcccgtactccggaaccatccctgttatcgccgcacagagggcgctgttcgccccttcccggttggttcttgcgccaatcacggaattgacatatggggtcgcactggattccgagaaagcaatcacctctccataagccggaacattctgctgaagataaggcgtacagtcaaaggtaagctgcgctcccagcttccggtatgcctcattcgtggcaaacacgatattctttccctcatccggaacttcatggagatgctcattcagatatttgatgcagatgctcggattgattgtcggtggaatcttgcactttgccccttttgaaagcagcttttcggcaaaccacaggtctgcgtcctgtgcgctgagcgccacatgggttctggtcaccgggaaccatcctcggtgcatcgaaggtctctccgattgccacctgaatctccatcgccatggctgcgccctccccatacttaccgttcagcacatcctgttcataatttgtgagtttcatttccttcctcctcgtataataagtttgtaagcaagaaaaaccgcttacagacttattcttttttgggtataaatggtaaggatatctaagaggtactcccctcatcccgattcccatctatacagttgatagttacatttcaatataggtagatcctgtggtatgatatcaggtagagtctgatgtccgaaggcactgcttctcctcctttcagccggcttcgtccgagactgctttgaaagcattcagcctggcacatacggcacattccgctgacacagaattttcatccccagccgttagccccagcaaaaaaggctgactgggtgcatgctcattgcgcgagggttcggtcaccgtatgcggcacaggataaaccttttgcttcaggcttcacaaatccccatcggaatggaggtgatatcatgttaaagctcaactatatgtccaccttgtttgtaggtattgatgtaagctcaaagaccaatgctgtctatgctatggacttcgaggaaaacaaatacatctcatcatcgtttggcaataaccagccgggtgccgataagcttgttaatatgattgctgagtgtatgcacaagcataaaaacctgaatacgattcttatcgtgctggaatccacttctgtatacagcgtccatatttcaaacttcctatcgaccagcgaggttctcatgccctacaagccttacgtcttctgtgtaaacccaaaggccacttcgaattaccgaaagtcctatatcggaatggaaaagaccgatcccacagatgcatatctcatcgcagactttggcagggtaggccgtacgaaaaaactggagccatggcgcggcgggcagttcatatccctgaaacgccttacaaggcaccgtatgcacctttctgagtgcatcaccagggagaagacttatatggtttcgaatctttatctgaagttcagtgaacttcagctccttgaaggtgatgacaagccttttggcagtctctatggtgccacgtcctcagctgtcctgacggaatttttgtctccgcaggagattatcgatatgccggaagaggatctgcttaccttccttgcggggaagagcaggaaccgcatctctgacctatcaaaaacttcggaactcctgcgcaaggcagccagggattcctaccggttagacaagtgcatgtatgaaccactgagcatatcactggcaagctcgtttaactgcatccacgcctatcagaaagaaatcaagctgatcgagcaggcgattgagaaatgcatcaacggaatgaaccctaacgccctgctcatccttcaatccatacctggaataggtccgatatgggcatccggaattctatcagaaataggcgatataaccgtgttccattcatccgatgcccttgccaaatatgccggcctttactggcctaagggtgattccggagatttcacttctgaggacaacaaaatgtcgaaagccggaaatccctatcttcgctgctatcttggcgaagcggcaaacagcgtcaggaagcacatccctgaatatgctgatttctatgccagaaaatatgctgaggtaaccaaacatcagcacaaaagagcactcgcgcttacatctcgtaaattagtacgactcgtttttggattgctggtcaaaaaccaactgtacaccggcaaaaagctggacaccgaatataatattgagtcgaactgacattcggttatacgtaaaatataccgaaggtctgttaaagttacccttttttctgaaaaacatatcaaaatcttcttcaaaaagttcttgacatatcaccagaatgctttttcaattggactattccgatattttctaaaatcaaaacaaaaataataattttattattttcttttgatttatgttgaaataatatactttttctagtctttcgtcaagtttattcagacaaacaatgggatcttaacaaatccttcgcactattggaatgatccaatttacctttgtatcgtataacacacatcgcagaacaattttttattaaatcacagaacgataacctgcacgctctgcgcacaggtctcatcatcaacaaaaaaagattggttctatactgaatgttggggtgtgctgaaaagcacacttccaacattcttttcgttgtaataaaatacatctataagaagcctcctaaacgcattatcccgaccaaagtttaatgttatggaggtgaccccttatagatgtaccctaattataccaaggctttccttaacttggaaggtgtttctattaaaaaagtggttcaggcagactctttcattaaaattttcatccagtcccaaccggtagaacagacttgtccctgctgtggggctaaaacaaaacggattcatgattaccgtttacaagaagtccaggacattcccttactgggaaaacaagtaatcctgcttcttcgcaaacgccgctacctctgcccatactgccgcaaacggttcacggaaccctattcgttcctccccagctaccaccgcaggacccgcaggctggcattttacattgtctccctgctccggcagaccttttccttaaaacagagcgcaaagcttaccggtgtttccgtccagacggtctgccgccttctggacacgatttgctatcctccgcctgaccagcttccacaagcgctttccattgacgaattcaaaggcaatgcttctaccggtaaatatcagtgcattctgcttgatccgaaaaagcgccggatcctcgacattctcccagatcggacccagagccatctggctgattattggcggaacattcccaggaaagaacgcctgaaggtaaagttcttcgtctgcgatatgtggcgcccctacaccgaacttgcacaaaccttctttccaaacgctacaatcatcgtggataaatatcatttcatccggcaggtgacatgggcgattgaaaatgtacgcaaacggctgcagcgctccatgccggtttctctgcgtaagtattataaacgcagccggaaactcattctgacccgctacaaaaagctgaaggatgagaacaaacaggcctgtgatttaatgcttcactatagcgaggagctgcgtctggcacaccgcatgaaagagtggttctatgatatctgccagatggaagcgtatcgtcagcagcagagggaatttgatgactggattgcgaatgcgcagagctgtgggatcaaggaatttgaggcctgtgctaagacctacagggcctggcgaaaagaaatcctgaatgcctttaaatacgggctgacaaatggtcccacagaaggatttaacaacaagataaaggtattaaaacggagcagctacggaatccggaatttcaaacggttccgaacccggatacttcactgtacatcataggataaaaaggtcggtaatgcggaggcttatttggcatgcccaaaatcagtaaaacctggaactaaacataaaaagggcccttttcatagaattggggcgggattttaacaaatcccaccccaactattgacaaagagcccaaagattccgtaatacatgcctgtatcacggaatcgagggcgtaaatttttttgtgtctttaaaattggaagttccattcagttggaattagatatgtagcaatttttggaactttttgtcactttttccggatgttccatctccttacttttagtattgccagaaagtctggttctatacatttttaggcacatcaatcaggcatttatagtattttaagttcgtgggctctgcccacacccggcctctggaataagctgggattttctggcaatactataaatgccgacggaataagctcggaacggttttcgtctttggagatttgggccgttccggctttttcttttacagatactgcgttaggcgttccccgtacagcaggatgagctggccaatcacctgatcccagccacggtaccgctgcgtccactttttcattacgttctggcttgccaggtacagcatttttgccagtgaggcatcattcgggaatacacttttgttctttgttgctttccggtactggcggtttaccccctcaatgatgtttgtggtatacataatctttctcagttcgccagaaaactgatagaacgaacttaaatcttcccaattgtcctcccagctgcgtatggcataggggtatttctttccccaggttcctttcaatgtttccagttccaactttcccatttcttctgttgaggcattgtagaccgctttaaaatcggaggcgaatttcttcaagtcgctataattgacatatttaaaggaattgcgcagcatatggatgatgcaccgctggatctgcgcctgcgggaacacagtctggatggcatcccggaagcccggcaggccgtccacacagaaaaacaggacatcctgtacgccccggttcttcaggtcattcagcattcccagccagaacttggaggattcgtttgcacctactgtgatgcttaggatgtctttatagccctctgttgtaaccccgaggacgatatacgcggctttgctgacaatgcgtccctcatcgcgcaccttatagtggatcgcatccatgaacacaaacgggtacagggaattcaggggccgtgactgccattcttttacctccgggaggatgcggtccgtgatcttgctgaccatctcggccgacatttcaattccatacaggtcctggatctggtcatggatatcccttgtgctcatgccccgtgcgtaaagggcgattactttttcttcgatgccggaaacatccctctggtgtttgggaacaagctttggctcaaactccccgttgcggtccctggggatatcaagcgggaactctccaaactggcttttgatagttttctgagaatacccattgcgtttgttgtctgtgtccagcccagccttgtggtttttgctgtaaccaagggaggcatccatctctgcttcgaggagttcctgaagaatatctttgaaactatcgcggaggagggagtagacatctgccacgctggagatgttgttttctgaaataatctgtcgaatttgctcctttgctactgccataaaaagactcctttcgagtaagaatttccatatctgaattcttgcccgaaaggagccatttttttccaaagacacaaactattttacactaccacggaatcttttttatattactatttttttaactgttttatgtccgtccttatggacagaaagtctattattattgaaacatcgacagataaattactgtcccatctgcttagcaacttcctcagcaaaattctcttccttcttctcaaggccttcaccagtctcgaaacgaacgaattttttaactgcaactttagcgccgtttgctttggctacttctgctacatactgtgctactgtctgttttccgtcctcagcttttacataaacctggtcaagtaagcagatctcttttaattctttattgatacgtcctctaaccattccctcgatgatcttatcattcgcgtccggcttctcgttcttagctgctgctgtaagaatctctgtctctttctccaggtaatcagcgtcaacttcatctctgtttgtgaataatggttttaatgctgctgcctgcattgccacgttcttagccattactttcagctcgtcattaaccacgtctgtctctacgtcaactaaaacaccgatctttccgcctgcatggatataggaagcaatgaaaccgttagcctcttccacctgtgtaaatcttctgatcttcatgttctcgccgatgatggagatctgggaggaaagtgcttctgcaactgttaaggactgatccttctcccacttctcatttaagaaagcatcgatatctgccgctgttgtgttaagagcctgtgctgcaacgtctgcaacgtaggtctggaacttttcgttctttgccacgaagtctgtctcagcgttaacctctacgacaaccgccttcttctcgtcagctgataatgctgtagctacgataccttcggctgcgatacgtccggccttcttagctgcgcctgcaagtcctttttctcttaagaactctactgctttatccatgtcgccttctgttgctgcaagagctttcttgcaatccatcattccggcgcctgtcatctcacgtaattcttttaccattgctgctgtaactgctgccattttaaaatccctccgtatagttttgattatgcctgagctgcctcttctgcaacgtcttcaccttcgaatacaggagcttccgcttcgccctgtcttgcttcgataacagcgtctgccattctggaaacgattaattttacggctctgatagcatcgtcgttacccgggattacataatcaagctcttccggatcacagtttgtgtcgatgataccgattaacggaataccaagtgtatgagcttcctgtacgcagattctctctttcttaggatctactacgaagatagcatccggaactctcttcatctctttgataccgccaaggttcttctcaagtttctcccactctttcttgagtgcgataacttctttcttaggaagaacgtcgaatgttccgtcttctgccattgtctcgatctgttttaatctgccgatacggctctggatggtcttgaagtttgtaagcataccgcctaaccatctctcattaacgtagaacataccgcatctctcagcttctgtcttgatagcgtcctgagcctgtttctttgttcctacgaacaggattgtgccgccgtctgctgcgatgtctgctactgctttgtaagcttcgtcaactaaacctacagatttctgtaagtcgatgatatggataccatttctctctgtgtagatgtacggagccatcttagggttccatcttcttgtctggtgaccaaaatgtacaccagcttccagtaactgcttcattgaaataacgctcatgtttctttcctccatttggttttattcttccgccgtcatctttgcttccgcggggactccattgattggagcaccgtccttgagaatccgtccggcgtgattttttagcctttatactatagcacaggcgacattattgtgcaagctttttacacgaattttcaaatataatgtttatttcgagaaattctcatatcttactctttcaaaacaggccaaatccctgccccgtcactcacaaaaacgacatcccggttgacggtagtataaacctgagtcccattttctttaaatgcctctcttatctcattctccggctcctgtgccgtcactactgcgtattccggctttaaagcttcgattaattcaacgccccgtttggaatttcttccatggtggcccgtcttgtatacatcgattgcgggaagatccagcttaagcagttcaccaagccgctctttttccgcatctcctgcataaaacaggtgaatatccccgtgcttcaccagcacggccagagagtaatcattggatttattataatggaacttctccggaggaaagacacggatatccagatccccataggtaaacaagcggtctctgggcatcgtttccaccgggatgcgtttctcctcaagtctggcaagcagctcctgataaagcggtttttcaccttcaaaataaggcgcaagaacctggactacgggaatctggtccagaagataggatgcaccgccgatatggtccttgtcgggatgcgtaagtatcaggcagtttattttttccactttattatctttaagaagctccagaatgtggggcgcatcttcctcctcccccgtatcaatcacaacacaggtatctccgcttagaaggatggaacagtccgcatcctctttcgtaccggcaaacagaaacttcgcctcccgcgtaacctccctgttttccagcagataccatccagccagaagcgctgcacacaatgcgcatactccggcggcccgtaataggaaaacggaaaccttacgaatatttttcatttaaatctccattccgcgcgccttcaggcgcggcacaaatagtgatgaaagattttcaaaacctctacttcatgcgataataactttcaagaagctacactacaaagcacgggaggaggagttgtaaattctttctcgttttagacagcatttaaatcagtgtaagttctgccttttcaagcacaaataagtggctctataagaccgtacactaagaattgttttaacgccttggttaatttgtgtggcagttcagtcaatggcttcttatctttttcagaaaggagtctgactatgaaagttacttacaaaacctgttgtggtgtcgatgttcacaaatcatttctcgttgccacaatcattactaccactggtggtatcgaaccttcctatcagaagaaacgttattccacctttaacaattcaattcttgaattcaagcaatggcttcttgacaatgactgtcataatctttgctggaatccaccggtaaatactggattcctgtctttaatcttcttgaagatgaaatcaatgtcaccattgccaaccccaaatgggtaaaagctgtaaaaggcaacaaagatgatactaaagattctaaatggattggagttttattccgacttggacttgtaaaaggcagttacataccttgtaaaaagattcgtattttacgcgagttcacaaggtatcgctataagattgtttcctgccgttccagtgaaaagagtcgatatcagaatgcgcttacggtttgtaatgtcgcactggattctgttgtatccgatatctttgggaagtcatccacatccattattgactatttgcttgaacagtctggcaattctatcaatcatgaagaaatcgcttctaaacttcttaagagcctcaaatctaaagaagatgccgtgattgaatccattgaaggataccagatgactgattcccaaaaatatcgtatgcacctcgtccgtgcacatatggattatatcacagctgaaatcaatgatgtagaccgtgaaatagaaaaattgatttcttctgatcctgattttgaaaatgcgatccagtttctaatgactattccgggtgttaaacgtgacagcgcaatcactgtcatctccgaaatagggattgatatgactcagttttcaagctccaaacgtttatgttgctgggccggattaactcctggcagcaatgaatctggtggcaagaagaaatccgttcgggttacacgtgccggtgtctacctcaaacctgcattagtgcagtgtgctcatgcagccgtcaaatccgagaaatctccttactacaagaagaaatatgaatctctgatgaaacgccgtggcaagaaaagagccattgttgcaatcgcccgaatgattcttactgcaatttaccagatgttatcaactggtgaatcatggaatccaagcgatttgtataaaatcggtatacctgaagctttactggaaaaacaaaaagcaaaagccatcaagcaagccatgaaactattgcaacgcgagggattatatcctccaccagaaccaatagcttcttaattgttgttttaataaacacttataaaaagttgccacttgctgacagctcagataagtatgccacttttgggctgtcctctactttctttcacactaaacctccgtgaacactcatatcaatggctcatttaaaatttgagaatatcagcctgccaaaatccgtcaggtcattggacgtccatccgctgtatttatcacagctgcttcggatcatgctgtgcgcttcctctttattgccaagcgcccaggcggtccagctgatccggtgttctttcatataatcaatgaatggctttgcattctcctgatatgttactgcttcattatcgtactccccgctctttaggacggcttcttcctccgccgatgtcccccattcactgacaaagacgggaatcccctgtgccacaaccgattcaagcagcgcattttcacaaggtttttcctccgtaacatcaatatagcggtgcatcgtgtacatgatattatcatatttcaaaggctgctttgacggtccggtaaaatcggtacagtaattgggcgttcccaccagtatcactgcttccggagcattggctctgattacaggaatgatctgctccgcatattcgacaatatcatcccagtccgtatccccattcggctcattgcaaatctcgtaaagaattgcaggattgccgctgtagtggctgcttatctcagcaaaaaattcctttgcctcttctgcatattcattcggatcactgtcctttagaatatgccagtccactatcacatacatatccgccgccagggcgctctctattcccatatataagtaattaaggctctgaacaggcgcttcaatgtatgcattctccggttccgtgtacacggcaattctctgcacattcgctccatactccgccaatgtcttcatcgcgctgccgtttaaataccggggataccatgttattccatggctgctggttccgcgcaggaccatgggactgccctgctcatccgtcagaaccgggccatttacgtgaagagcgccgtgggcgctgactcccgcccccgcagttttttcctccgtatcatctgaaaagccgcagccggccagtcccgcaatggcggctatactgccaagaaacaatatgcgtcttaaatatctcatggtttattctccattccaaaaggaaatgcctgcccgctcagattttcgggataaagagccagcagcacataatcgtaatgattttcttccagaaactttgatagcttttcctcatccgtctgaagcgtccataacatatcaacctgtgaaaaagactgggccagaaaagctccgaccggcgttgcgtaggaatctctgagcagaagaatcttcggtccggaatccatttcgagatttcggattgagacgtattcatccactccattgtgaagatagacacgctctgcctttccattatagacattctcaagccctgggccattctcctccaaatctaaaagcgcatccttaaagcttccctgatacgttttatattcccctgtcattccccgtttcagagaatactcaccaggtgtttttggataaatcaccgtataatcctcggttcctccggcataaatcagccccgtctcccgcccctgggaacccagcatataccccggaagcgttacctgttcatattgagcaagatccttaagcttaccgtccggatccagggaaactccgaacgactgctccatccactgaagaatatttttgtatccttcaaaagctgccctgggtgtccagtggtgatccgttcggaaaaatgcctcctgctgcgtaagcccgtttgtctcacaaagagtttccaaatccaggaggggaaccttataataccggagccatgccgcgaaatctcccgccacctccgtataatcattgtaaggcaatccataatagccttccttttcttccggcactttcatcgggaaaatcacggcgcccatctttgtcccgcgggcgctcagttcatcctgcagcctccgggttctgacagccagttccttctgatcatccccaaagccgttccagaaattcgctccgtagagcatcccgtcttttcctttcaaattggtaaaagcgttttcttccttctttcccataagcacctgaagagcgccgtaaccttcaatcagaggatagcgaaaaagcagctcttcgctcatctcctcctctatcccccttaccgcctgtttgggattgtgccatccctccctgttttctttgatctcttccagcagtacagggccatgaaagaatatgttaaatcctgaaaataagaacagggatattataaacagcacagaaaaaatatgttttcctttttttacgtcttcttccatacctctcctttcttaaatcagaaattaaagtaaataaaaggattgtatccgctcttggatatataaagcacagctgccgcaaatacggtcatcatcccggccggatacaccacccatgccagtttcggataccgtttgaacaggcgtgtgcctgccgtctttgcagcaggcgtgcacagtaggattccaattccccactgccatgcatattccttcagaaacatccaggtatacggactgaaaaatccgttttggttcatccagaacatatttcccatatactccttaagctggtaaaagctttcacacctaaacagcacccagccgagattaaccgccagaaggacgtacagatgtctccaggccgtttttccctctcttttctcgaactcgaacaggcgctccaataccaggaatgcaaaattgagcagtccccaaaacagaaaattccacgctgccccatgccacatgcccgttaaaatccatacaatcagcatgttgtggatcagcctgctcttgctgtccacccgagaacctcccagcggtatatagacgtattccctgaaccaggcgcccagtgaaatatgccaccgtctccagaattcccctatggagcgggaaatgtagggataggaaaagttctcttcgaaacggaagccgaacattctgccaaggccgattgccatatccgaataggcggaaaagtcaaaaaagatttgaagcgtataggcaaaagatcccagccatgcgagagtcacagggactgccatgaacctgtgccccgcattagtcatcgagaatatgttatctgctatcaccgcaaaggagtttgccagaatcagctttttcgccagcccctgtacaaagcgcacacatcctgaagaaaataaatcccatgtgtgggtccggtgatgtatctgctgctccaccgtgcagtaccggacaatcggccctgcgacaagctgcggaaaaaatgagatatacaaagtcacattcagcaaatttttctgaaccggagcggtacggcggtaaacatcaatcacatagctgagcgcctgaaacgtaaaaaacgaaattccaatcggaagtgcaagcggcaacgtaagcccggttccaaatcccaggatatcatccaaaacagatatcacaaagttccaatatttaaacagaaacaagattcccagattgcctgcgcacccaatcaccagccatattctgtctgcatttctccatttggaaagcgccagggcaaccgcccagttaaaaacgcaggatccgattaaaagcaggatataataaggctctccccatccataaaagaacaggctggccgccaggagaaagatatttcttagcctgatactgaacctgcataccgtatagtacaaaagcagcacgattggcaggaaataaaataaaaatgcaatactggagaaaaccaaaattgtttacctctttcaactaactttattttcttttgcttctgacagggcaaataactgttcaaacgcatcgcaaaaaagcagttctttccagttatccagataatacagtccggccttttggcctgtctttacacatttcattactgtttccgtacccggaatccgaagctccatcttatccggaagctctcccgaagcttcaaccaggagatattcataattgcagttaagcacccggatgcttttcccgtccgcagtctccatcgtccggttcagttcaatcctcggaagctggcgttttgaattttttgtgtgtgcggaacgtctctggacattcaggaatatatcatcaatcatgctcaccgacggactcatcgtctttgccagactgtgatcgcggtcatacagaatctggaagtattcgtccttatccgttccatccatgccggtaatttggattccgtacttccatttatcccccttcttctgcacatggacgcattttgcatccagtttggctttatatcgatccgttttgatttttatgctcatctgctcttccccatggggcatgtagatggatttatcacacagcaccgcaagtcctgtctcggaaaaatcgcaggtcagtccgtaatattgttttccctgatatgaaatctcgaccggaacctcggcataaaagcggtccgtagtccgcagattacggcgcccggacatgaaaaacagtgccataatcagatgctgggcgtttagaacaagccaatagataataacggccgccccgtagttttgtgtccgcagcgcgccggccactgccataaccagcgccaccgcgtcaaataccagcagaatcatctgcggaattgccagcatgatatctgaccttctgacgatatcgcgcctcttgctggtgacattgaattttttttgccggatgaacagagtttccagcagaaccgggattatcatatagggaaaaataaccgtatccacagtattgctccaccgcttattcctgattgctcctgatgtcaccttcagcgcctggttatacaggacataggagggcagccagataaaaatcaattctttcagactgcagataacgaccggaatgccaaacaatatgaataatataggtgaaacaatataaataaaccttctgaaaaaggtccaccagtacatccagcatgccagatagctgattttggcattcagttttatatggggattaaacagcagattcgtgcggcgcagtgaggtaatgcatccgcggccccagcgcacgcgctgcttaatcagattatcaatatcggtgggcgccagtccgtgggccaatgtcttgtctaccgcataacagctgtatccctttgcctgtatcttaattcctgtctcgaagtcttccgtaattgtcccggttgcgatgccgcccaccgcttccagggcctccctggatatcagtgtattggagcctgcataaataggggcgttcgcattgttccgtcccacattgatctcgcggaagaagaagtcctgttcattggggattctcgattcgctgaagaaattgtactggaacatatcgggattataaaagctctagggagtctgtataaaaccgatcttgtacttttcattcttctcctcctctgtacgttcctcccaggaaccgtctttcttttttttcatacggggaaggaaaatataggggactgtctccattaaaaaattgtgggtcggtatcatatccgaatcaaatgtaacaatccagggcgatgtagttttgccaatggcgtggtttagattgccggcctttgcctctttattgtccgccaggccgaaatatcccacccgcatttttttcgccagctccgccatttcggggcggtttccgtcgtcgcaaatataaatatgcaccttacttttgtccggataatccatatggcggcagccgttcactgttttataaagaagctccgtctcctcattatgcgttgcaatcaaaatatccacatcgggataccagctgaaaggcacaaccggcatatccggttctgatttttttcccagtctggcaaaatgctcggtaccctccagcatggaaatcgtctctgagactgccaggcagataccgcagattgtggcaagccatccataaacattgtgatccggaatcgtgaagaaaagacgccagcctatatagacagccatgctgataagggctatcacaatccatactttttcttttgttcccttcttctcctgctttgctatcttaatcttttttcccatctttaccaccttctatcgaagaccttcccttgctctctggaccagaataattgacacaaaaaatgcgatgatgaaatagcttcccagtaacgtgttgagagtattgttcttttcttcctcaacaaaataatataaatccgtaatattatgatccagaaaattcccatgctgcctgattgtatctttaactctttgcagttcatcctcccatgttcctctgttcctgtcaatctcaagtccagtcgctttttcttcgataagaggcatgggattgtgatactctttggaccatcggctgatgtctctctctgcaggtttctcgataaatctggcggcagcatctatccggctttcaattgtactcctgctaagtatagattttctaagctcctcataccgtgcagtcagtttttttacaaagtattgatccgtaaccagcttgtcgaaccagggcgcatcctgtaaaacaatttcatctgccttcagcagttcttttgggtaattatccatagccccgtcgaaatcccaaaaaggcccgatatgtattttcccgtcccggtctttatacaagaacgttgaattccaaccggcgtcataattagtgaaaaactcgtttattataaagtaatccacaaaggaatctatatcaagcagacttctgtactccaaaaactgatttctatcgctggaatacagacaatcttcgactttcctgatatcattttgaatagatgaccattgctgttgtgttatccgttcagatgacggatattccaaattaatccaattaatccagttatacttgtttttatgctcagtcgaccagaccggcatgtgaagaacgtccggatccaggcggtccctgagcaggagatatcccgaatttttatccagttcaagacgtccctcacctcgttcgattttctcatacagtccgtacaggcccatatattcatacttatcaccctttttttaataccatctcacagaaccgtatatcaggtgtatatgctgagatttcacccgccgtattcattgaaatatagtttctcaaataacttttatctaactgtgttccgttaagtatccaggtatccgaagccgtcattcccagcatccccactatattgggttcttcatcctctgtcagtagttttatcaggtactgtttttttggataggtttgtgaagaggatgtattcccccgtattttcatttttccataagacacttccgacgggacgtcacccagatggttaaccatattctcgttgtctattaaagaaatttgcattttcacatagggatcaactccatccgtataccggaatgattgtgattcactgtcaaaatatttataattcacaatctcctctccacccgtatcgatgataacaaggggcaggtgtgaggtgaagctttcgtccaccatataatcctcaggaattgtatcactgcccagcgtcggatccgcgcctgctgccagctcatgatgccaaatccggtcttcctttttatcgacctcctggtatttccagaaaccgaacacagcacaaaccgatatcccgaacagaattatggcagtcgccgctttccattttgcgcccattttaaatcactctttctttttccctgtcttttttcatccggctcatcctttgccttatgacgaaatctcatcattctgtcccacaagattcacttccgtcaccttttccagttccagaagcttccggctcagcttttcattctgccagacctgcacctgcttctccgacagttcatagatatattccaccatgtcccttccctggttcttaacacagaggcgggcctttccttttaacggttcctgaatggaggtctcaacttcttccgataatcccccaaggccgcggacaatgagcagatatctcgtattggcgcgcactccgccgattgccagcataagcaggaatatggtaacgcttccgatggatgccgtaacaaaatcagaaattccgcagcagattcccactgcgatacaccagaaaatataggctgcatccctggcatctttaatcgccgtacggaacctcacaatcgacaaagcgccgaccatgccaagtgacagcgccacattattgccgattacacacattaccatcgttgtgacaatggtaagcatccaaagcgatacattaaagcggccgttataaacagctcccgagtgtgaaaaacggtatgacaaaaatataataaaacctatcaccagagcgctgaaaaaattaatcagaagctcctgcacactcaggctgcccgcatggtttgttatgtaatataaaagatcctcattcatgacatagttcctcctaatccaaaatatctcgatgccgtatatttgctgcttgccgtctccgtcagctcgaaagatgaaagcgccgttctgatataatcaagcaggaaatgattatatttcacttccagtgtaatccgtcccggttccgtgaccgggtaatatgacacggaatcctgaaacaggttaaactgcccttcctgcgccgatacgccgctgtccaatgtaatcctgatatcattggtcggaaccgtaaatgccagcctgctgtacttgacaatgcatttgggccggtagacctcctccgtcatcatcgcgtaaaactgctttggaagatccccgtcatagtccagcagacaccggtaatctccccttatcagcttttctgcatccgtctttgaaagaagcagactctgctttctctgtttggagccctgcttccgcttccattccagctttacgataccgccgtccccatagctcctcaggcggattttctttctgaattctaatccgctgcccttttccatatagtccctattgtacaatgaatcaaaatataatgatttaacaatatatggtttggcattttcacagtttccatcgagcggaagcaaatatgacagcctggccgttatctggcctgccgtgagaggggaaaccgtgtactttttttccgtacgcagaacatccaggaattccgacattgcctaaaccttcctttcaataaattaattatgtcaaattactataccaaattgtaacgttgatgtaaagttcccgtaaattattatttcaattgttactataaattgggatatttgtttctgaaccggtggagggcatgaattctcaaacttataatagaaaaaaggcggcaaagaatattttgccgcctgtaccaatcacttatttacttgaaaaaatcatggtagatttctgttattcctcttccttttcctggtacagatagagccaaggcgcttccacctgaaggttcccgaactcgtttctgccgtactcttccctctttcttccttttcccacccggatcagccggtcggcgagagccagggaatcggcaaggttaaccgccagtatcaccacggctatccctttatccagaaaccgttccagaagttcccaaacatggatgcggattgagacctccgctcttttaaacggctgtacgcagaaaacgactttaggattctgcacaagaattctcatatagatcagatcatacttttgtttgtgtgacagctcctccactctcaggtcaaagacttcttcaccgaggagttccgcatattcctgccgcaggcttttttttatcttattcgtgagccatacgtcatgaaagcggtggtcgagtgtaaagcagaggttatccagatagcttaaattggagaacagcattgtctgcaccggcacctcctggattatggcaattctgcggtccggtttctgcctgaactccacatctcctatcctgatatgtccctgctccgcctttttttcccctgacagcaccatcagcagatccggaaggaaacggttatctaaatcctgaaggacaagacattcccccggcgctacactaaagctcaaatgcttcacctctccgaagcataaatcctcagccagaaaagctgtctcctgtttcagcggtttccccgcttttttggcaatctgttcgctgacgcgtctgtcaaaaccctcggaccagcggtacatataagtgtcgggcacatgctccgataaaagaaagtatttgattatctgtccatccttcatcaccgccgtacggtcgcatatctgctttacctcttcatagtgaggcgcaatataaagaaacgccattcccttgtctgcataatgacggagaatccggtgaagcttctgcagctccatatcactgagaaaggagctgatatcatccaggacaacaaggtaatttcctgccacaaccgcctttaaaagctccacgacaaaacgctcaaagggggacagctcctcgatacaggcatcggcgtcaatgtccatctctatatcctccagaaacggcagaagctgctgccggaggattttcggctgcatcaggcgtttccggaagccggggcgcagcacaaagatattgtcggccaccgtcagcccctccgccagacagcttttgttctgaattacgctgatcctgttcatcgatgagtcggaataccgccagtggttcaccggcttttcatggtaataaacgtacccgtaatgaagcggcagattctgtctgagaagtttgatgagagcggagattccatgacggttcacaggcataagtcccataatctcaccggcccagatagacatgctgaaattctccagctgggttactccctgttcccggtaagtgacacgttccattctcaatgtttcttctctcattttaatgcctctttatttttgatgtccctgtcgcttgtaattgcgggaagagaaatttccacatccgtacctattccgggcatggaaaatacatggagtccgtattcttcgccaaacagaagatgaattctgttattaacatttacaagggcaatccctcccttgatttccgtattctgtgaggcaaaggccctgccgctcttctccagcctctcattcatcctggccagcgatgcctcgtccattccgaccccgtcatctgagatgcggatcagcagccgcttgccgctgcgctccagccggatggtgaggtgcccgcttccgattttacactccgtaccgtggataatactgttttccaggattggctgcatcgtaagcttaggtaggcggcagcagtatatctcgtctctgtcgtcgggatcgcactctatcgaaaggctcaggcgtgttccgaaccggtactgctggattctgaaatatgtttcacagttctggatttcttcctccaccgacaccagattttcgaccttgctgattgtataacggaaaaatgtggcaagggcctcggtcatctccgccacactgcccagtcctgcaatcagcgcttcactccggatactctcaagcgtgttataaagaaaatgggggttaatctgattttgcagcgccaggtactgtgcctgccgtttgttcagcttcagcagctcagaagaatccatcatatcattcatacgctcaagcaggcggtatccggccggggtaggggtcacgtcatacagagccgaaatttccatcgtcgtatagccgtccgtaaacagccgcatcattttctcaaaccgcagatacggcttcaccacaaagtaaaaagaggctccgattatcccgagaaaggccgtaagtcccaggaaaaacggccaaagactgccctcctcgaagataatcatcttcaggcagaaaagaagtaaaaacagaatcagcagcgcagccgctgcagacagcaaaaaaactctgtgtgacagatactctgtgttcttcctatccaaatcctgttccctcctctgtctgatttactgcagtccggctatccgtacagctttctgtactccgcagggtttaaaccggccgttttgtggaatgtatgggtaaaatgcttgcggtcgctgtaccctactctctcacaaacttccgcgaccggaagatttgtctccctcagcagccgttttgcctcatccatcctgacgcgtgtcagatatttagcaaatccttcccctgtctcttttttgaagagaacgctgaaataactgacgctgaaaccggccgcctcgcagacgtcttccagggtaatcggctcatgaaaatgctgcattacgtattgttttgccagtctgacgggacggcccgcctcgctttttctcagctccccggtctcacgcagcaaaagctcctgaagctcctgaagctgtgcgaacagttcctccacccggcagcactggcggcagcggtattcaaaatcctgtttcattccttccacgtttccgacggcacatctggcgataaaaaggtggcccgccgcaagcgccagctcataaatctccctgccacagatcccgtgggtttcaatggccgattgcctgagcatcatgcaggctgaggctgcctcctccagactgaaggtttcaatggcatgttccgtcgcctttacatatttatccagaagattctgcttctctattcccgaacctacgggagtggcctccagaagccgccccggtccctccacaaggcgttccagcaccgcgcctctggcttcctcaagcgaagtaacaagacggccgcattctctcaccgccgttcccagagaaagtgtaaattctacaggcccgtacaggttctttttggcgtccagcaggttcaggcattctctcaggtgccttctcacttctccccttttagacgattcataatttaaaatgccgtagcccgtataatcctgaaagtaaagatggtattcggggcaaacctccgacagcccgttttcaaatatctccctcgccttctcccgcaaaagctcatagggagagccgccgaccttcctcacatcacagtctattttcagcagaaaaacctgataggcgtctccctgtatctgaaaatggtatgtatcgtgaagtatttcctccgtcaattccgggggattgggcgacaacaggtcttttacaaggctgctgcggaggcgtctcagatccttctggctgttctgatggcgctgcgccatcccttcctctttatcaaaccgggcctcacagcgctccttcatcttccggagcgtatccatcagctcttcttttttaatcggtttcagtaaataattgcctacaccaaactggatcgcgctctgtgcatattcaaaatgagcataaccgctgataatcacaacttcaagctgcggtctcagttccttggcccgccggatcaattcaaggccgtcgcatcccggcatcctgatatccgtgatcagaatatcaggctccagagcctccaccagctgaagagcctccaggccgttttccgcagtgcctgccacctccattcccagtgagtcccaatcggccagggcctgaacaagccggcagatcagcttctcatcgtccgctataattactcttatcatacttggcccctccccatatctgttcctgctgccatacgcatacggctggcttcgcgggcgtgtacctggcgcagatagatggtgctatatcacaggaatttacacagcgctgcactggtacgcctatgcattaccggtgcaaagatgcataagaaccgcctcctcagacgggatactgggaattcctcccgtcacctgggttgaaagactggccgcggtggatgcaaacgccgcaatagccgccagctcttccaccgtcaggcagtcaggctctttcccagttttcagaagacgcgccacggcgcttcctccgaaaatatcgcctgcaccggttgtatcgatcggtttcacaggcgggcatactgcccgcgccccgccgtttctgttggccagatacgcccccttaggccccagcgtaatcattgccagcctgacaccatattcattgagcagcttgccggcagcctctgtttcatctgtgattccccataagaattcgacttcatcatcgcttattttaaccacatccgccctggacagtccccacagtatctgttctctggcttcctcccgggatttccagagagggggccgcagattagggtcaaatgtaatcatctttcccttttcccgtgcataggcgactgccttctgcgtcgtcgtacggaccggttcatccgtcagactcagcgtaccgaaatgaaagaccctggctccatcaatcaggcttaaatccagctctccgaataaaagcctggtatcagcccccggtttccttgcaaagctgaaggagcggtccccttcagggctgaaagtgacgaaagccagagtggtgaacacggtatcatccgtcacgattccctttgtctcaactcccgcatcggcaagagtccgtacaagaagcgttccgaatgcatcgccgccaacttttcccaaaaatgcggtccttgcaccgtaagcattcagcgccgccagaaaattccccggcgccccgcccggattggccttcatcgtcgggtatcctgccgaatctgaagaaagcgccgcaaaatcgattaaaagttctccaattgccgttacatcatacatgatattcccccatccgtcccgtaatcttgttcactcatcaaatttctgcactcttcctcaagcgcctcaatctcccggcttccttcggcgatacagaaacgtatctcattaatatgcttttcaaaaggagccagcagcctggttctgcccgcccttccgtcaaatccgcagttggccggctcgagcgccattgcatagtcgccggaagcgcagctcttccactgagccataagcggaatcttcttaacgttccatctgatacataaagccagctccctgtcatcatttacaaatgctccgaatgtattgccttcacgatccgacgccagactgtactggaacacctgctccgcctgtccgtcctccgcctgtcccatggaaagccggccggccattcctttttgcgcttccccgtctctcggaatacaggaaacttccgggagaatcagtctgctttccggcgtcagaaaaggatagccggcattgcagtgatataaaaagcataaaggctccggtttaaagccctgattttcaatctcatcatgaaacagaatctcattggagccatataccgtctccaccgtccttctgaggatcatgttttccccaaaaatttcagcctgacgcatctcacccgtcacgcggattctgtattgatccccgtcaaaaaatgaatccatgccaatcttttcagcgggagttgtcctgattcttccatgcgtcggatactccaccccgccaaccgtcctgtacccatggacatgatccaggccgcaggtaaacattgctccgcccataatggaacgtaccgcctccctgcctgccgtatcatagggattcctcccctgaagccccggttttgacagaaagctcatattaagccctttataacggatccaggccggatccagacatttatcaagcatcagcaaaaactccagcggcccgttctgtaccagggcgcacctgagtccggaggctcttccatcctggtattcaatccggcgcacccctgccgcctgttccaggctgccgcagaagcgcagcaattccttcttgtcagccattcagctattccttcccctgttattttgctgccggatattccgtgcagagcagacggtagggagcttcgtcctcttcgattttcgggaaacggcccatctcctcataaaaacggttatccgtattatcatcgttgcactggcttacctctcccagaaggacagcccccgttcctttttccacttcaaaatcgtgatacatataaggataaatcgtgatgctctcccccggagtcaggcgcacctgcgtaccggccggaaccacaagctctctgccgtcaatatgcacatggacgtcattcattttgtccagatcttcttccggtgtcgaattatagacgcggatcagaacattgccgccgcccctgttaatgatatcttccatcttagaccagtggaaatgcatcggagaatactgcccgtccctgatatacagcagcttctctgcataggtctttgtatatttgccgttcattttcaggtttccgttgcggatggtaatcaaagaaaagcctgtcttttcaaaattccccaggccgtaatccgtgatatcccatcccagcatgttgtcacggatttcatcgtaatcatgtcccttctcctcccactcctgcggtgtgaagctgcagaaaggcggaactgcaaagcggtactccttcaccatttcttccatctcttttaatgctgcattaatctcactgcgtttcatcgttaacccctcctttttttaatcatatcatgtacgatattacaattcaacaaaaacgccgagcctgaggtccggcgttttattattactgttcacacggttgtgtactgttattttttaagtacggaaacacctgtatccttaacctcgccgccgagggaatttccttcaagcgcctgtacacaggcctctacacccatggaacccattacgtctggattctgtgccattgtgcaaagtaaatatccgtcgtcgattaagccgagtatggcatcggatttatcaaaacctactccgataattccgtcttttcctgccgccttaatggcatttcccgctcctgttgtggaaccttcgttacagccgaagataccgactacgccctgggtgatatagttttccgcgatactctgggatttggccgcatcaccttcgccgtactgtgtttcaaggatggtgtagccttttccttcaaatgcggagcggaatccctcttcacgcatgacgcaggaatcagttgccgcatttacattgattacaccgatggaaccggaggttacgcctgccgcttcaagagcttttaacatctcttcgcctgccgtctttccggcagctttgttatcggtggagaatgttgcctcagcctctacattggccggtgagtcaacatagacaattttcacgcctgctgcctcagcctcttttaatgcagaggagatggcatccgggccgtttgccgcaaccatgattgcgttgtaaccgcctgccacagcgttgttcacacactcaatctgctgtgcgtcgtccttggtgttcggggacatgaatgtaacggtaacgccgagttctgccgccttagcctgtgcgccttcattcagggttacccagtgctggtcgatggaatccattgtgatcagagcgattttccactccttgcttgctttcgccggagctgctgccgctgcacctgctgctcccgccgtcagcacggatacgcctgtatcagttacttttccgccaaggctctcgccgcctatagccgctaccgctgctttaacgccttcatatcccataacgtccgggttctgtgccattgtgcagagtaaatatccgtcgtcgattaagcccatgatggcatcggatttatcgaagcccacgccgatgatgccttcttttccggaagctttgatggcatttcccgctcctgttgtggaaccttcgttacagccgaagatgccgactacgccctgggtgatatagttttctgcgatgctctgggatttggccgcatcgccctcgccgtactgtgtttcaaggatggtatagccttttccctcaaatgcggaacggaatccctcttcacgcatgacgcaggaatcagttgccgcgtttacattgattacaccgatggaaccggaggttacgcctgctgcttcaagagcttttaacatctcttcgcctgccgtttttccggcagctttattatcggtggagaatgttgcctcagcctctacattggccggtgagtcaacatagacaattttcacgcctgacgatgctgcttccttcagagcggaggaaatggcatccggaccgtttgccgctacgataattgcctttgctcctgccgatacggcgttgtttacacactcgatctgctgtgcgtcgtcctttgtattgggagccataaactgaactgttacgcccagttcctttgccgccttctgcgcgccctcattcagggttacccagtgctggtcgatagagtccatcgtaatcagtgcgatgagttctcccgaacctgactctgccgccttctccgtcgtggctgcacttccagtttctgctgtctgtgaagtttcctttttgccgcagcctgccagtgccgtgacaaccatacaggatgcacagaaaagagccgcgagcttcttcatttttttcatgtaacttcctccttttttgcagtcccctcagcccggaccttccgggccttttaaccgcatttttcattttatcttagcgcctgtaacggcggctaattcaataccttctgcctgtaaccgttcagatatcataaactgttacttctgcctggctttttcaaatccagccgtttagctggtgcgttttttcttaaagagtccttttcggaataccacatccagaagtacggcgaataccacgatgataccaatgacaaggcgctgaataccaacctgtacgccaatcatgttcagtccgttttccagtgtctgccatacggaagctcccgccagcgtgccgagaaggattccggtgccgcccagaggggagataccgccgataacgcctgccgcaaccgcatacatttcgtacatgtttcctgcttccatattccccatgttagcctggccgcagaggattaagccaaccacgaaggaacagaacgcgctgacaagatatgtttttgtaatcgttgccacgacgcttacaccggaaagctttgccgcttcaacgtttgagccgaccgcgtaaatatgacgccctgttctcgtcttggagagcaggaagaaaaagataataaataagacgattgctatccagaacgtattgtatacgcccgccgtctttccatagtagaagaaattctggaatttatctgccgcttccttgccgataccggagctgatagcgtccgtgtttctgttgccgttaaccatatatgccacgcctctggctacgaacatggttcccagcgttgcgataaacggaggaagctggaatttaccgaccagaataccgttgataacgccgattaccaggcagcaggcaagggtgatcagaatggctaccgccggggtcacgccgtgggtcatcagcgtcgccgagatcattgcgctcatgccgaccacggaaccgatggaaaggtcgatatttcctgtaatcaatatgtagctctggccgataccgataatcaggtatttagacatggaacgcagaaggttcatcacgttctgtcctgaaaatacggtcgggttaataataccgaatgcaatatagattacgattagtccggcaaatgccgtcaatgccccgcgcattccgcggacacccagtattctcttcaccggattttgttttgtctgattcatttttctcccccttatcactcaccgctggcaatctttttctcaaactgcgttgccagtgtcaatatctgattctgtgttgcttcttccgctgccagctctccggtaatgcggccgtcgcacataacgataatccggtcagcaattcccataacctccggcatttcagatgaaacgaacataactgcgatcccctgctgctttaattcattcatcaggttatagatttctactttggcagccacatcgattcctctggtcggctcgtcgaaaataacgaccctggagttacgtgccagccattttcccacaacgaccttctgctggtttccgcctgagagattaccggcctccacttccaccgtaggcgtcttaaccttcaggttctccacgacgcgatcgcacatctcatgctccttttggctgctgacaacgcccagtttattacaaagcaaatccagattcgggagagcaatattgtggcggatactcagctttgtacacagcccgtctttctttctgtcctccggcgccagcacgattcctgccttgattgcatcctccggtttattaatcgatacttctttaccgtccagcactatcacgccgctttccttttgatccacgccgaatatcgctcttgtcgtctcggtccgcccggcgcccatcagtccggcaaagccgacaatctcgccttcatagagggaaaatcccacgttcctgacctgtcttccggcatttaaattctttacctccagaaccagttttcccttctcacattccactctcgggaacttttcttttatctcgcggcctaccatgttggcgataatctcgtccatcgtggcatctttaaaattcatcgaagtgatgtactgtccgtcacgcatgatggtaactctgtccacaatgtgctggagttcctccagcctgtgtgagatatatacgattccgcagccttttgatttcaaatcccggataatccggaataaatcttctatctccctggctgtcagcgccgacgtcggctcatccatgatcaggatcctggcgttggtggagagcgctttcgcaatctctaccatctgctgcatggatacgggaagatcccccaccacctgctgcggccgcaaatcaattttcagctcatccagtattctctgcgcttccgcctccatctcagaatttgaaagcatgatcccttttttcttctctcttccgagaaacatattctccgctaccgagaggtggcggcacatatttaattcctgatggataatcgccactccgacttcctgcgcctgttttggactgagatcgccgtattccttgccgaaaatagccatgcttccttcatcccttgtataaacaccgctcaggattttcatcagcgtgcttttccctgctccattttcccccagcagcgccataacttcaccggaacgaagctcaaaatggacatgatcgagcgctttaactcccggaaagcttttactgatactatccattgaaacaattgtctcattcattttctgacacctgtctttcccctttttctaccctgcttttttcttcgttatggttctattatatcaaagggggtttgtacaaataagggggtaaagattgttcttatagggggttttttatgcattttgacaatggggtttaaagaacggaacgctttgtaccggcaaattgctgtatgattcagaatggagatttagttaagcaggtgaggacgccgccggtacggccagcggacggggtggtggggtgtgtatatgagtctttcgtcccggggaagattgttgtgagttgggactgcgggcgaagataaagtctgcggagcacgctcccgctctgtgaaatgcatcgcgctgctaagctcgtaagggacctcgctaatcagcgatggatttaggcggcatccgcagactttatcttcccctccgccccaaggccaggttttcgccgggacgaaagactccgccaagtgtatcggccccgtccgctggcctgcggccgctgaatgtctcacgcgttaagtgcagggcggaccttgtcgcggtcactaagagcttccgtgaacgggaaatacgatatgctttcaatgcacctttattaaggaattgtggaagatttgatatcggcctgccgtaaacacgtagtggccacgacaggggcctccccatttaaggttagagacaatcagcgcccggaacggaccatgtccggtgccgcgaaaacctccgcctgagtcttccgtccccggcgaaactctgcccaggggaagtaggcgaaatcaattgcggaggggacatgggagtccgccggtgcttggcgaggtccctcacgagcttagcactgttgcgcactccaaagagtgcaaacggtccccgcagcaattcattccggccggattccccctccacgaccaacttcccacggggacggaagactcagccagccccctcaccacaccggacatggtccgttccggacgcgtcctccacacctcagttaaatctccatactgtgcatattcatgatataataataccggaaacccgcaggcaggggtatgccaaatatttataacattaatttaggaggttgatttatgacaggcaatactgatgaaatgaaacgatttatggaacggctggagaagtccaatgccggacaggaaaaatatgctaagctgcaatacaggatgagccagattactgcggctgccagtatccttattctctgtattgtcctctatacggcggcaaccgttattccgagggttaacacactgtttaatgatattcaggcttccgtatccaatatacagaagatatctaaggatctgtccgatgccaatcttcccgaaatgattgataatatggaccgtcttgtcacaaccagcgaatccagcatcgagacagcggtggaaaagcttaattccattgattttgattcgttaaacagcgcgatccgcgatctggctaatattgtaagacctctcggaaagctgttcggaggctgactcagtcctctgcctttatggcagagagaaaacaggccaatccggatacggaaatatccggattggcctgttttcagagtcctgtattttacgggcggtgagccggtatcagtcaccctggaaataaattgcttttacatatccttttgaatccctttcaaggatgtttccataatagggctgaggaccatatggcccttcttcattaaaatccataacccggtaattccccggtgattcaacgatactctcccgcggcatatcaaaataaccgtaatattcctcgcaggctcctttcagaacataaactacgccctgataaactcttttaaacctggtgtccgcactgtttgcccagaagctatacaggccgctgtcaggattatacgtgctcataacgtaatctccctctgcttcgtcaccgaatacatactctccatattccggcgtctctgccttctttaaagtttttttctcacctgtcagctcatccgttaccagttccagctccgctccgccgtccagcgctttatactgctccgccgtcaatgtaatcggaactgagatcgttccctccgccgcataatataatcctttatcaaccgcgtgttctttatcggaagccagttctacctcaatctcgccatactcgggaagcagttcaaggtatggcgcaggctccagggcatcgtattctttttttgccattgcagcctgaccagcatcatacttctcttcagcatcatttaaaaaagcaatattcctttttatgagacctccgaggagcgcttcatcaaactgtcctgcttctgtgtttcccctgtaccacggctccgcctcaaaatattcagtcagatcagagctttgaaatttcctgccgtatactgcataaaactgattccgtatgatacgcaggtcttccctgctcatttcgagcaaatccgtgtcattcagaggccttcgaaatccttccggcaatttcagattatcattatatgagtagtaaatccctgcgtcttccccgtctccccccagggaaaccgtcccgtcccggttcaagctaagcagacagaaatttcccccgcctccggacatctcatcttccagattataggtatcaactcccgcctcatatggaagttgatactccgcaagccctgtgaccgcgttggagcgctctgcatctgctccttccatgctgcgcttgtatactgtgatacttaaattatcccgttcctctgcttctcccggaatgacagacagtctgtatctgaaatccccggctttgaaataagagccgcaaaactgctcccactctttgttttccggcgcttctgaagtcggagcttctgttttcatgccgctctccgtctctttatcaccgctgtcttcccttttattgccggcatcttcctgcgttttcccggtatccgggaggccggtttcttcctcaccccgtccgggcgaacaggcggtaagcgataatgccgtaagcagtatcagcatacatttaatactctgtttcacaaaaatcccccctagcctttattttccagcagtttcctcagcttctgcatcagtgtctttttttctgtcccttttgatatcaggtattgtttttccgcttctttcatagccttatccgggttataccggggcgcaggtgtgcgggaaggtgttctgccgtgtgttgattcaaactccttcaggcctgcattcaaatcggtccttgttttctgttcccacccgctatacacatttcctcctctcagcacatctttttttaattttaccataagcataatttccattccatttatttgaccggtcaaaatcattgcgtttttcttacaattcaattttgcagttatatttcttctcaatagggatatagataattctgtgctgttaaaaccttgttataaggttccggcaggattgacagcaaaatagaggatcattataatggtataaaactacggcctcagttagaggctgatagaaacaagggagataagaatattatggcagatttaatttatgaagtaaaagaccatttggcccgcattacgatgaaccggccggagcatcttaactgtttcagcgaggaaatgatccgcctgtggacagcagcgctggaggatatccgagatcgggatgatatttatgcagttctcctttccggaaacggtaaggcattctgcgcaggcggcgatgttaaagccatggccgcaggggacggtttctttgaaagccatgatgatattacctccactgctctcgcacggaaaaattcactctggaagggaattcagcgtattccgctcattctggaggaaattgataagccggtgattgcaaagatacatggagctgccgtcggcgccggactggatatggcgctgatgtgtgatgtacggattgcatcggatacggcgacgctgtctgaaagctatttcaacgccgggatcgtgcccggagacggaggcgcatttttcctgccccggctggtcggacgcgacaaagctctggatatgttctggactgcccgggtattaaaaggcgaggaggcggaacgcatcggactggtaacccgtaccgtagctgccgatcaactggatgattatgtggaaaactatatgcataagcttcttgaagctccgcagcaggccatgcgcctgaccaaacgcgcgatttaccagagtgaacagagtactctgcgttcttctctggatatggtatcctcttttatggggattgtgaccgaactggatgattaccgcacgcgtacggctgccctggttgagcggttgaataaaaaatcggagaaaaaaatcgagtaggaggcggtgattaaccgccgtcctctcacaccaccgtgcgtaccgttcggtacacggcggtttcaacagttgacgtgcacagactgataagctatggctaaatcataaaagccactgcttatcagtctttcttttgtcattgccatatttaccgctaccgtttgcgtggtaaaccaatatcctctccggctgtttcctgcctgccatgccaaatcttccggcactcccattttccgcaggttcttcaccttggttctcggtttcttccattgtttccatatacacattcggattctgtggtatagccacttattgagttcttctattcggttcttcatttccgcaatcccgtaataattcagccagccacacatatacacttttatctttgctaatgcagggcgtatgctctgaactgaccttcgggaactaagttctttcagctttgacttcattttcttccatgactttccatgaacccggacatatatgccctttccgttctttcccaatgtaaagccaaggaatttaaaagttcggattgcaaacacgctgactacacggcttttctcttggttcactttcaatttcagcggcccttccagatatttcgtgctcgtctccagcagtctcttggcagctctctcgcttttcgccagcagcacgatgtcgtccgcgtaacggacaaatacaactccacgcttctgatactcctggtcaaactcattcagatagatgtttgccagcaggggggaaagatttcctccttgcggcgaaccttcttctgtttccatgactactccgttttccatcacgccactctttaagtacctcttaatccactggattaccctttcgtccctcacatttctgcgcaggatattcaggagtatctcatggttcagggtatcaaagtatttcgacaagtccaatgctaccgcatggatatatccccgctctgcatactctttcaccttctgaatggcatctttcgcgcttcttcccgggcgataaccgtaactgttctccgagaacaacggctcgtagaccggtgtaaggcgctgtgttatggcttgttggaaaatgcggtcttttacggttggaatacctagctttcgtattccgccgtctggcttgggaatctccactcgtcttaccgggtcgggggtgtactttccccttctgattctctcgataagttctttctggttttccctcaggtatgcgcctatttcctccacggtaatcccgtcgattcctggcgctcccttgtttgcctttactctcttaaaagctctgttgaggttgcccttctccagtatctcctccaagagttccggctgtgcactgtccctttccttccatatccggcggaaagaacggtgcgctctcacatacccttcacgttccgcgctatctctttgcgagcagctatctttgttttctgtacccaatgttctttcctcctttcccagttgtactaaagactcctgttgattcggtccttcatctctcgactactacgacctcggctgacttctgtacgttcagcactatctttcgataatggttatccctttcaggacattccgcacagacctccccgggtaccacacgtctctttctctccatctatctgccacatttaccatacgtgattccgtgtggttattgggcttcgacttgttcagcagccttaccctcacgcatggcctgatgtgatttctgtccgtcagaccagagatttgcccatgggttagtatgttccccacatccggcttccttcagatttcacctcacgatgaacacccttgccttcggctatatccttcccaccaccgggcggattccggactttcaccggttagagacgtgcgccgccgggcgcactgataaaacggggaaccgaagcttttgctttacggttccccgagatttttcacggaggcttgcttactttactatatgaaaaggaatcagtatggtgaattgtgaaaggtttctattatagaatgaattactcataaaaacgcccaaaatctcaaaaataggccaatcttataccgcttggaagaaactttgtcccgggcaggaactttcttctatttttttaatatactgtagtataccacgagggtattaaaataaataaaatgaaattctatggaggttccattatgagcgataactataacaattgtgactgtgagcagagagagtcctatgactgtgactgcaaatgctgctgcgactgtgaaaaagtaagacctatcacacctaacagaacaacattaaaatgcggctgtccaggcgctgtcacactcccgcttgccactgtagcaggtacgaattttaccgtatctacagtcaccgtagatacaaaagggttccgcaaaccatgtattaaatttgaatttgccagcaatattgtaacaactgccgccgttttaactcttaacctgcagattttcaagcagtgtaaaaatcagcttgttcctatcccagtaggaccagtttggacattctcacgtttagtagcagtaacagccagtgacgcattctccttctttgtatgcgactgtgatatctgcgatacagaatgctgcacttacagtgtcgtagcaaccgttgccggcatcgcaaccgttggtgttacttctatcaataacgcaactctttccgctatcattgttgacaactgtgattgaccaataatgtagtaccgaaaaggagcagctatgtattatagtttatttggaagatatcattatccaggtaccagaacatgtaactgctttcctcagaaatttaagcaacaaaataataacattggacaatgtaatccccccgtccagagcaactgcccaaagcaagtaacagacaaattctgcaaagacagcttatatataaaaagctcagctttcgggggatttatattgcctgaaggtacagaaaagggagccacattacatgtggcttctcttaatctgaatactttaaatcatgaggattttgttgtccagttaaatttttcctgtaatattatcacaagtaaaataaagctgcgactaaggtttcagctttttaagcaggaaaagggacagtgccttcccactcctgtcagtaccggcgtattatattacagggacaaggaaagtcccgaggcaaatagttttaccttatcggcatatgattgtgattcggaagccagtacatgctgcaactatagcgcctgtgtaggagttgaagaatttgcaacaggaggaagcgtcataattgcaaaccctattttatccgcaactatagcaaatacaaattgatataaattatggaaggatctaactatgtcagttaaaaaatatcaagataacaactataaaatatccaacattagtataaaagataaccttttaagctgggaaatgcattccgtaccggtatcagggatcagccagatatgggcaggaataaagcccgcagccccctttccgttcaaattatttcttattctattatttatagccttatccgcccaaacggttgccggccatattgccatgttgattctattcgctttcagtgctgctctgtggctgtattatcatcggcctgataaaaatatgaatcaggtgaatatcaagctcctttccggtgatgttattacgtttacaagcagcgatgaagaatccctggattcattctataaagcgttacaggaattcttgagcagacgtggttcaaatattgaatttgatgcagacgggaaaaaaattgaaacggttgaaattgaaccggttaaagaatcatccggaataatggggatggataaaaaaagcacctcaaataatcctttagtcaatgatttacgaaaactatatctgggatactcaaaaaagtcagatacgaacagtgaaattttacatctcatcgacaatactgcccgattaattgaaacggatgacaaggaaggactgaaatccacgctaagggaatttatatcccaggggctgatcggcgagtgtaatgaattggggcttgattcattgatacaggaaatcaagaataacatttattaaaggtataagtttaatatgaaaaatacaggcaaaagtcaaagctaaggccggttggcagcattctgtacagatgctaagccacccggcccctttatttaatatgctgagccatacgcagagcatgcaggtttatagaacgtgcaactctttagctccatgtttaaatgctgtcaaaatagaaataatttgtatttagcatcgatattgtgacatatggatttccaagctttttcttgacatcgagaactatcttacgaaatgcatggtagtatacttctctgtccctgcaaaggacgggatttcgtgttgctatgattcttatcccgatactgtccatgccgcaccgatctatggtatcacatattaactccatggattcgattactccatttataaacactccgcatcctgcttcttcaactaatgcagctgcaatccataattttttcacatccgttattccaaactgcttatcacccacgctgtaaaaattcacaatatatctttcggtttccattctgaacttcctttttctaaaaatatatttccccacaatctaatttattcggtaaaaaggcccgtacagttcccgggccagccaaatttatgggtttttctaaataaatatgtagtgccagtgtaaaaatattacactgacacatggacaaatcaggttgctgatcaattaggttacaattcgggtcaccgtaaatccatctgttttttgaagaattgcaaactggctgtaagatgtaccggatgatgagtaggaatctgcttcctcagttttaccaggagtatatacgttggcagttatcttagtaagcagacaaacgccccggcttccggccgtccagcttccccagggggctatttcaaaatcatcgctggaacaggctgcatacttcactgtaccttttacagtataattggtagagttcactatatgaacctttggatatgccataaatttacttcctttccttttttagaagcttgtcaggcttctaaaatattatatgtttatggctgacatttgtgaatccaaacgataacctgcacgccctgtgcacaggtcaccgccttcaatacaaaaaacgcaggataccttgctgttacaagattcctgcgttaaataaaaagagcgcgagacgggattcgaacccgttaaaccaaaaagcctgaaacccttgattttaaaggagtccagtaaatacaatactttacagccgcacaatcatgcggacaaccgcactgaaaaggtgttccgtgttgcattttgcacggtcatgcaacacgaatatgcaacacggaataaggcggccggatcgctcctggccacccttactaccccatcttttttcgtgccaaaagttcatcatatgatacacccaatacatcttttattgcctccaattgcgatgcatatatgtgctgtctgccaccttctattttcacatatgcctctctcgttatgggaagtccacgcaactgcatttctctcaccatatccttttgacggatttgtttcgctttgcgcaagtcgtggatatttttacctatattaatttctgtatcactctttattttctgctccattgtcacctcaaaaagaacccatattcgcacatttttactgattttaactttaaatcatgatacaatgggactaatatcagtccttttagtatggggcaattggtaaaaattatattcatgggagggcaagatgaagaagcttaagaatcgtattaaaaataatatcatgtactactggtccgttatcggccttgccgtaactggttcagtctgccgcattatccattatgtaaaaacagggcgattgccccacaaaaaaacaaagtacagccaagaggagattcggaaggaactgagaaagatcgctgaagaggtcgaaaaagaaaaagaggccccagctgagggtccggggcctgaagagtaggatatggcaaacccctcttctgtttataaaaacgattgaggggtttgattgtgacaaaatattacaaattttgcatattaaatttgcagattgatactttcttttgtttttggtatacttctcttagatgggggagcggtggcaagcccgccctcctctgttttccctaaagcctattctgtaggcttatttttattgctgtctttcggcctccttgattaccttttcgataatctcctttgccttatctgtgtttcctgtatctattaatgcttgtattgaatatagtaatgtcaaaagttcaagtcttgtcatttcttccatttttacctcctctctcctcttgcctggtaactcgttaaggacttgccttccttaactatctccattatactatacgtacgtaattttgtcaactgtttttatctattttctcctctattgcagacaaaataaatgcccttactgattgattgcatttctttgcagccggtgctatgacatcatcgtaatactctttttttacatccagtggaatcctctttaagtttttcttcgcatagctgatgctatactctttttgtttctcatcataagccatattttcacactccttcaactttagaatacctcattttcctctatacgtacataatcaaatttaccaaaattacgtacgaaacattgtgcatcttgtatatttacaattacgtacgtatagtatataatacgctcagaagttaagaaaacagtaaaaatgaccagcagctccgccccggaggtcacgaaggcagaaaggaacgttatgaatacacataggacagttaacggggtcagatatcacgtggttgatgatgcagacacgctgctctgtaagttgcaaaataaggctgatgattactactacgataatatgagatgcgacatagacaaggttgaatctgacatcgatgtgctggaaaaagcaatttctgaaaatgatatcaaaacaatggataagatgatatccgaatatcatcagttgtttaaaaggtaccagtaatcacattcacccgccccggccgggtaacgccgggagaaccatgctgaccctatcggcattacgggggcgggttagtgggcacgtcccgagagttcgccggtatcgtttccgtgaataacgagtgttctcacattccgggagtatgcgtgagagcgaaaggcgcaggcacaaaaacctgcatagcaggcgggtgaaagaccgccccgagagttgctggcttggcgcgctcaaagaggcacggttgcaacgtcatagcaggataaaggagggagattatgctggatagatacattgcaaaacagattatatttgctcaacttgcttcggacggaggcaagaaggacaaagaggtattaaaccgcatttcctcctttgtccctttatcagaagtgcattataagaaagggtatcacacaaagggtcactgtatcatcaatgcgatcagagcaatacagcgcaatccgcagagtggatttagataccacgtaaaagcggatcggacattatacagtggtgcgcatgtctttattgtctattttaactttaagataggagaggagcgctatcagatcagctttcatacatttgacaatatgtggcgctttgtcaaccagcaatgtgtcacgcgctggcaaaaaaagtatagcagcaaagaggcagtgataaagttagtttaccatgtatacaaataataaccgccccggtccgggaataggccgggagaaaggaaagaaccgtgtataaatatattaatataaccgagtaactttattttaaatttaatcgatatccctcttgacataccacccattgagtggtataataaatacataaacaagagataaacaatttctaataaaaaggagagacgaaaatgaaaaaagaatatgcagttaatatcgaatctgtaaacagtgatagagattggaacaccgccgatatggctgactggtacgattcttatgatgaagcgtatgacgcagcagaaaaagcattttctgacccggatgttatggaagcacatgtaagcatttgggaagacggagacgttgacggaaccccgttaaggatggttcgtgaagatggaaacgttcaccagtaccagggcgaaacaagattgtgggcataaaaagggaggggaagagatgttatataccacgtttattagactatgtgatgaagctgtcagacacgaaaacgccgaagagtttattatgaacctcggctggcaggaatggatgaaaaaagcagcagatgctgatgaaatcacaaaggatttgtcactgatttttgaacttgcaagcctggattttccgggcttgcgcaaaagacttgatgttagcatggcgaaaatgtcaacaatgtactggattccattacgttccatcgaaaattgggattccggcaaacgagaaataaaagactattatttaaatttcatccgatacacaatgtttgtccaggaaaaggagggggacgatggatacctcggctatattgcagaacaggattgatttctgcggtattattgttgcagaaagatgtaacccgaatggcgatccgattaatggaaatgtcccgcgacaagattttaacggaaatggaatcattactgatgtctgcttaaaacgaaagctaagagatcgcctttcagaaaatggatatgatgtttttgttgttaagcaagaagaactgctggatgaacagaaaagccttcacggcaaggtaaaggcggagtcagacatggttcgggctgcgaaatcaaaagataggactgcttaccgtaaaattgcctgtgaaaaatggattgatgtccgggcatttggtcaggtatttgctttcaaatcttccaaagcgtcaaaagaatccgaagaagaattaggtatatccgaatgtgtccggggacctgtttcaattcaagacgccgtatctctggattatataaccgtaatacagaaaaacttgacaaaatcagttaattcaaatgaccctaattcaaggtccgataagtcaagtgacacgatggggacccggtatcaaatcaattatggggcatatgtctttcgtggttcaatatatccacaactggcaaaaattacaggattcacgtatggtgatgcactggcaatcaaaaatgccatcataaatatgtttatgaatgatgcatctgccgcccggccagccggaagtatgactttggatagattatactggtgggaacataactgcccgaacggtcaatattctcctgtgaaagtctttcgcaccctgcaattttcgcctatggacgtacccccatattacaagacggaattgcttaatcttccaggattggaacctgaagtgatagaaggctggtaatattctataacatggcaagcccctcttttgcttataaaaaagcggttgaggggcttttaataatcatctttaaaataagcggaccagatgcacctggtccgcttttcaacttaacagaaacttccaatagcttaaatgaagtagttttttcaatccacgcccgaaacgggcgaacagcaactgttaagttgatattacgatacgcagagtatttaatactctggatttccttttattttaacattacagaaccgttttgtcaatgtgacaaaaatcagcaccaatcaatttttagatactgaagtacgcttaaattatgtaccttctggcaatctcgtcatactcagcaatctgtaattccccctggtcatccgttaccatacatttaccctcatttactcccttttccgggcaaaggtaatattttcgtccgtccggcgccgtctgataacctgtcagcatatatccggcagcatcaaacaaataccatgcagatgttcctgttgtaatctccgtcagccagtaccagccgctgtgtgcgtagctgccgtctttgtactgataccaccaacgttttccatcggccgcccgaataaagccttctcgataaatctcaggctctctcgcaaggctccaatcgggtaatccatatcccaggatacgggagtatgatttatcatatgactttgcgcagactccaccaccgttttcgaccacgcctgatgctccggaagtatttccctcgatagttttgaccttactggccgtcacctgcgtcacgataccagtgtgataggcacgtgtcccgttggtaaagaagataaccgctcccggctccggtgttttgctccaccggccggctgccttaaactggttaacccccgtcgggcaataatgatacaacgcgccgcccagcatctttttggccgtctccaggccaaaggcctgtacaaacacatctgacacatacatcgcacaccaaggctgcgcctggagattatgcccggtatgcttataatagtccctggcaaagcaggtgtaattattgctgccagcgttgtccgtaaaactgtccaggtctttattgctcttcttttccaggtatccattccatttcttcgccgtctgaatcaatttgtttactgcattttccatttacattcctctatttgtaaaaaggcccgggatttccccggggcctatgtactgttgttgcgacgtcgcaacaccggtataaccccaccggccggaagatgcaaggatcaccgcccctctatttctgcttgtcaccctgtccataatcgttgctgtcaatcttgtcctttaagaccgcgatatatttaagcagccaatccggcaccgcagcgcccattctgccagcgttttcaatgatagacagtaattcgttcagtaagtaccaaacggccaccagaaggccgaaaaacgcgtttgtcggcattgcaattccaaggcttccagataccctggctattacataatcaactaccatcgccacggcgatcacgcacagataaccaacctttttgatgatacctttagccccttttttgctgctccatccataccctttgtcgtccggatggtcaatagcctcggttttgctggcaagcatgcccgtgatgtagtctaagaccatcatccccattaaaacgcataatacggggtacaggattcccagcttgtcacttaaaaaagcgccggctgctgccaaggctccctgaattgcaattacgtattcctttttcattgtctgtctcctttacttcgccggattctctttcagccatttttcaacctgtggtttccaccacgtttgcacctcttccagcgtcatttctcctgctcttatttttaacccgtaaaatcttcccattatgacatccctcctgcttgttccgctagacttcctgcaagtttggctacatcattgatggccccgtcctgtacctgctgcccctcttcaactactgccacgcgctctgtaagccgttccacatccgttttaggacgcagactataagttgtcagtaccttaccgtcgggggccaccacggacgtttcagacaccagcacaaggtcggtataggttccgaccgtcagcccggcgccgtttttaatctgcacttgcgacaggttgtctggcctcaactgctgccaggtcgccagcatggcagcgcggtcaacggatgcgacctgcaaggcccccaagctagctccggcctccagggcgatctctgtaccgtcttttaaaatcagtttgtctttgttcattgtctatccttctttcttttttattttttgtatataaaaagagccctgaaggactcttgaattttctggttaaatggcgagataaaaatctcatacagaagctcagacgtaacgacggagtggatcataaaaaatccagtaagcataggcatcctaacaaaagctgttccaggatttgatttccccctggaatatacatggctttttatcgcaatttccgacggttggggggccggtatgctggtgtttccttacggccaggcaggtagtaatcttgttattggccagtacgacagagcatcccttaagtggagatggacaattaagtaacagccttcttctctcctaataaaatggcgagatgataaaaactgccgatgccacatggtttgataatggtctgaaaattagtattattggaaccccaggggatgcaaattatcgtttatcattccaaagcaagaaaaacaatgtgtggtatggggacattttgtttgataggcatgattagccttcaattaacaatacaaaatggcgaggctattaaatgcatgtttggaatatcagatcgagatttaaataatgccacacacccggggatatatttagtagactttggtgcttccagtgtaaaaaacggaccagatacaggagaatactttacgggagcgttatttattattagctctggcaactttctaattcagttgttttttgatggcaaccaatattttcgcaaaagattttataattcctggactgcttggattaaaaccactcgtgatttgtaatcattaaatggcgatctgaaaattaaattcctggacgtaacctgccagaaagggaaaacagagacagacgaattaaatgcatatgacaatatcgtaaccggtatggcatcaatgtcaaacaatgattatattatcgggtatatattgattaacgagagactaattatcaattcaacaaccgcacataccgtaagggtatattacatcaacgtccccaagggataaccaccagccagaatctgaaataacaatttaactgccaaaaccttacgcaaatttgcctgtttttcatcgcttgtccccagccgcaaaaaacattatgtcacctatcctattttggggtacaacaaataagccaccctctcggctgactaaaaaaatgctttccatcaccccttaggcagcatatttacggtaagattcccggacattatcctgtttgatattacagtaaatcaatgtcgtctctattttggtatgccccatcaagaccattacttcttcgattcgcattccgcgattcagcaagtcggttgcaaaggtccgacggaaccggtgtggatgcacattgccgactcctgcctttttccccaactgctttaccagatactgcactccagccactgttatacctgtatacggctttttcacggccgcaaacaagggcttctctgccaattcttctactgttagtccctctttttgcatcctttctttgaaataccggaacaggtggaagcatgccacgtctgatatgtacagatgtctctctttccggccctttcccatgactttaaactcctgtttatataaatcaatatcgcctacctttaagctacaaagctcactcaccctgacaccagttgcatataaaaattcaatcaacgccctatcccggctgcgggtacatgacagtctcaatgcctctatttcttttgccgaaaaggcttgttttatagtactttcaatacgtaaactttctattctggcaatcggattttccgataccatgttttctttttgcaggaatgtccagaaactgttaaggtatcgcatcctcccctgcagcgttaccatactgatattgttatgttctctcaacattccgaagtaccacctcaaatccatcgttgtaatgtcctcgatatttttattcaaggcgtttcggcagttgcttatttcccttacatactgggccagtgtattgttctgccggccggatacttttttactggcaacaaacaacctgattttagcagtatcgctatccgttccagttgcctgcagctcgtttttttcttccacaatttttttatcgtggaactggatataaagcacattttgaagcttatccaactgttcttcgtccagacagttactcatcgcctggacaacattcatcaacatttcctctaacactcaaaaacctccttcctgatatctctacaatatcaaaaaagaggttctttcgccctgatttttgtaagattttctcagctaaattgttattttgcattgttgtttaagataacgtaacgcttctccatccccgccaaacaaaatcgtacgaagttcgtactttcacttgtacgctatccctggatactccaaaggcaatttgggctttgtaaccatctatacctattgtaaggatattagcactgatgccatcaaacggcgcatgggatgccgtcgaataggaataggccaaggatgggctgggaaggtcgtttacatcgttacccgtatccaagcgtgtcacgtttagcaatatatacccgataatataatcattgtttgacattgatgccataccggttacgatattgtcatatgcatttaattcgtctgtctctgttttccctttctggcaggttacgtccaggaatttaattttcagatcgccatttaacttagtaagcagattctcagctgcagtaagtcgatcccctagtgccttacccatcggaccggacagaactgtggatgtatctgttgccagaaggttatttacaatcttagcagcgtcaattttggccgaatcgagagactccagggctaagattgccgcgttcgctgcatccgtgacacgctttagtgcttgctccgcgtgatttagatttgtttcgtccaaatccggctccgaattatttacatatattgttgggacataagtttcaattggatttatgtttatactcatatttcctccttattcaaatttgacagaatgtaaaaacaatttaaaggtatcaaccgtaaatgatacgaacagactcaaataagcacttcttgatagcgcactaacatttatctccatagttctaatcgtacccgaagtatcttttttggtaatctccactgattgtgatgctatgctcaatctatccgttgcttgatatcttatatttttttcacgcgtaataaatgcttcaaaatgtgttgttgcgcttaccggcatgtagaccgaatattcaatcactaatttatttacatatgtcaggtcaatcggagcattaaaaacggaataaaccatgtttccaccactgctccccaacttaatggcgtgaaattccatatattttctatcttctatcctatctgccttatagcttccataatcgtaagcaatatagtctgatatggattgccctggagcgaatgtgccacgatagtaaaaagtctttgggtcagttacaatatatccttgccaggttccgggacccaccccacctacatattcgcccagcttaataatctcagggacaaggttgcttagcttgtccacgatgatattcccggtcatatacatgccgtctgtgtatacggtaatctgcttactgccaggggtaatatgtgtttcttccatcgtcgggatactttgtcgtacttctccgccatcatattttccggccggaagagtcaaccttccattcaaatcaatatacagcgtcggcgaacgccgatcctccatctcccccgcatgcacctggccgtcgggtcccacatataacttgcctttcaggacgtcgccaggcttcacatttaatttctcaaagtccgcgctctgtataatcatgtcaagtaatccatccgccatacttcatcactcctcatccggaaagccctgataggttccaacaatatctcccaccggcacaccatccttgattacctctggccgcaggttctcgacgctcattatgattgtgttggatgtcagcaccttgccaatgacgtttaacgtaatccctccggctcctgggtcgatcgtctgtcccgtttccgttttaactcccgtttgtcgaaacacatcttcgccaccatgatacccgggtacgatgttgtatctctcgttgatcgccatatcctttgtgattgcaggtattaccggcatagcaccttgttggggctctttgctgccggcgcccaaaaactttatcggctgtttaacatcggccggaaccgcagtcaggccagaattgtcgaaaccagctccatgctttaataagactccatcagccattacttacccctttcgcggacactgtaatactagttccaggttttttgctgtaacaatatgccgtcacccttccgtttccggatgcgatgcgatctatgtagccccaggccagtttctgggcctcaacagtcacgttgcttagggttccagtcagacgcaggccgtataccggtgtgtcagactcttttatccctgcaaaagaaactgtctgcgtatacggcgccgtgctgctccatccggaagcagaaaacgatagcaacgtctcccccacaaaggctccgacttgtgtctccaggttttggacgtcttccataatctcacttcggaacgccgtattgtccttatcaatagcgttgactgctctattggtggcgttaaaatcatcagccgaaaaaatatctccctcctgcgtgtagacagtgacatcgcgcagagatatagttccgtcttcattctggaccgtctgatattttcgatttccctgatagatatcattcttgtaattttctttcagactcacagtttcacctccctatttcccagcgcccgggtgccaaccttaaaatcaaaatgctgcatccccggagaagaccgttctaccagtacgccaatgtcatggataatctgttcgataaaattcgcctggtaaatggaggtatatgtgatgcgttccggagtttgcggcgtactggacggcgtgtaataggctgcccgtattgctgccagattgtcccgcagccgctccatctcactgtctgtccgtcgatcctctggcttccagtttactttgttgtgggtttcgtttcggtatccatactggtttaagacgtgggatacccacttgatcgccagctcgattcgatttaagtcctggtaatcaatgtaggccttcgtggtcatatcctgtacatcctgcaccgttctgtcatatataaggttgtctatatacttactcatggatagttacctccgcgcggatttctcgcaggctgaattgatagtcaatgctttccaacgtcccggttcttcggccatcatagccggtatcaacgcctaccacctggccaagcaccttatccgccagcagcacatcgccgaccacgttttctgcccgttgatagtattcatatacccggtttagtatctcctgggcgtttccagcgtgcaccaacgtcgcgtctgatacttctttaatatttttattaaaggcaatgttgggattttcccgtaacattgatgatgtcatgtgattgtattttttaccagtcagcactaccactgcaccggttccggccacaatggcatagttagcattgctctctatgatttccccgccggtaatagacaggctgtggtgtggatcagaaaagataatctctgccctgccagataaaacatcgttgtatagttcctccacctcctgcgtcggctgccaggagtgaacggtcagccgcacaccagtaaccacatcgttatgctccaacgtcagaccgtcaaaggtatcggcagtggaaaactccccacttaccgctgtctgctgtggatagattaagactccatcatagtttgatgtatcgaccacggcaccagccgcaaaagccagctgcacaagcgcgttgtgtttggtcgtgtaggggatatgaccatacaacgggacggaaacaagagtatcgtccaggaggtaattaaagtcctcaccagaaaacagttcctctagcacggctcccagctgctgtccggtgtaaataccgccgtggtactcgctgccgtccaggactccaatcgcgtcgtgcgtgtccatatagtaatccgtcttattttttctagccccattttttaaataaaaacttcccaatcgacggccattgaagaacaggttcagtttctgcttcttctggaaatcaaacgggatgttagaacgtgtccgggccgtgaatgtcatggtgttggtgctgacattttcagaaatggcgttgatttcctgttggcaggaaatttcgcttatttcatccccgaaaaactccctgtagattccgtaatcgattcgggtcacaaataccggccggcgtggcctggatgtctcaaggaaggcgattacaatcttgtcataagactgtacatagttgctacaaaaataccgttccgaatccggcgcgaactccatggacgacaacagttttccgtctgcataccattgcacattaatttttgtacaataatcacctgacatcaaattgaatgtaattaagataccaaccgaagtaaatttctggctgaataggacggtcagctccgggttacttaccttccgctccgacgttttggccggaaaaaagaatggtgctggccgaagcccgggccgtggatgcagaccgactgtggtgtacgtgtgcgaaaactgccggtcttcccctgacaattcgtcgctgatatatccatagtcggacgcattatccgggaagttgacatattccccgttcagcagggcgaaccgtggtgcgcaaatggaatatcccggataggtcaggtcatcccgttttaagtccgggaactcctggcggacagtcgttgcccgggggtataatttcgttcccgggtacagccccttcctgggccgcaggccaatgtcaatcacctgcggctgactgtgttccttggcatacggggctacgtcgtcatatacaattttaggcccttcgctattctcgatgacgtctgataatatggtctgttttagaaacatcttacggcctcctttgcggcgccatcgccacgaaatacacagacaagccgctccacagattctttccatcaatgcgtttcaagctgtccttcccctgcgttacgtaggccttaaactccagtgtttcctgaccatatgggaaaatcattcggtgggactcaaccggggcggagataatattgtaaaacgtgtcatagtccgcccggtgttccgactccggttcgacttccagcgtgtagttgtaaaacgttcctgcaacatccctatgcatactaaagtcctgcgtgcggccggagttttccgtgtcagtgaccgagaacccgcgctctagtttaatgacgttaacgcgaagttcaacgccatcaattgaaaatatgctttctctcatgcttatccctccgttaccagtcgaacaccgacacgctgcttctgctcgttgtttagcttatataccacccggccaagacgctggcggtcaagatacatgtttacttctatctgacgatttcctccgtctccacccatgtacttagccattacgttgtccagtgcctgttcaatcgtcgataacggcgagacaacctctgtctcgcgattgttgtcccccaggatagccgcaaactcgccggcgcgtggcggaaccacggtgccagtggccaggcgagggattgcctgcgtagccaaattatagccctgaccgatataactgctagctctactgctgtattcgctcgcgctgcttcccctcgtcagcgcacttatagcaattccgcctaatgtgattcctgctgcagctgcaacaataaatcccattgctttcatagtcggattcatcatgatactgcccaacgcgatagccaacaaaccaactgctcctgccacagcgatgattttcgtggccagtttttcttccggggtcattttatcccacgcttgggcgacaagcgctgccgaggtaataattagcccaagaagcagcgtcagggggtcaagttttccgattaggcctcccagcgtgccaatcaagtttggaagaaccgtcaacatattcttaacacccgttacaaattccacaaacttaaatgcggcaaaaaagcccaatattactgtggccattatttcaaccagttcttgattttctgatatccacccagaaaatttcttcaaccattctacaattttttcaatcgccttgataaatacctctcccgtccattttccaaacggctgtaaaaattcctcccacagccatattgccaatggtttcaacgcttctaacactgcgtcaaatgcgtccagtgctgccgctatcaaatcaaatgctgccggaagaccattttccagcccccacttagcaagcggaagaagaacatccttcaatagccataacagaatatcccctattttgcttacaattggccgacttgaaaccagaatcccgtcaaaagatttcagcagtggtgaaaaatccagcgtagccgaccatatcttaatctcccctgtcgcgtcgcggaagaatccggtcacctccaggagaaggtcacccagatgacgcataataagtagccctgtatccccgcttttccatgcctggtcaagcccatctgcaaggttcccaaccgtataaagcagatttgatacagaaatcaggacatcatccgtgatagcctttccatagccttccttttcccaaacagtcataaaagactggccaacatcatttccaagatttttcaatcgaccaagtgcaaattccgcagccgaaacaaccgtcgctccattttcatcccaagacttccgcatcgggtcgaacagacctgacagcactcctttaactgtctccgcaaaatccttgatatcagcctcaacctcgactgtctcaaacatctggtccggtgtcggagatttgtaagcatctgtatccacttttccgccctgcgcctgaatcaaatcatcaaaggcaaatgccagtttctttgtagccttttctttctctttcagttcgtcatttgtttcctttaaggatcctgcataatcctcctctacatccacagcctttacaaaggtgctttttccggtcaacgccgcgatgaactgcccggcgtaggtggccccggtagaaagcaggtctatcatttgtttcaaagccggtgcagctacctgtagaagtggcgcgaaggctgttgcaaagctgttattcaaacgtgtattagctgacatcagaagggatatgcttttgttcgtttcatccgaatatctggccaaattctgaaagccctcctgtgccgatttgatggcggctcgtagagacattcggataagcatcagtttgaacatattggacagcttcaggacactctttgttagcggaatagcttctttcctcatccgcttcatggaaccactcatcttactggcggatttaccggccttcttttgtgtattgtccaccccaatcagggattttttataagcctcagctgcctttttagccaatgcaagacccttgtatgccttgtcatactctgggtctcccaggccaagccctttttgctccgcataatacagagcatcctgataacggtccacttcgtcctgtaatgtccttgccttcgttcttgcactgtccatcgacgcgccggcacgttggaaaattgccacaatgttatccggaaagtgcttaaaggactccacggcgataagcaaagagtctttcagccctacaacagaattttcctctttctgggtttcggccgttacggtagccgatgcctgccttgccgattcctccagttcccgatttttcgcaatcatagcatcgacatcttgtccgtaaatattgtaccgcttcccatcatcgggaatggtagacgcaggggcattgttgtttgtaatcgttcctgtaaaagtcgcggctttctccttctgaagtcgctccatctcttctcttgtttttctggccgactcggccacctcatccacctgtcgggccgtcgccgctgcggcagaaccggaagacgaaaaggccttatccatttttgttgacaggttatcaatcgccgccgtaagcttttccgctgcctttaaaaggctgcctgtgccttcttcgaatccgtcggtatttatcttcgtgtcaaactttaaacttccgtcagttccgccagctgccatactatcacctctcctccgggcataaaataagacgcctgttcagcgccttaacccaataacttattccaataatcaatttcttcctgttcctcggctgtgtatttcttcttcaaatcacacagggccttgttattgcggtaaaattcctgctcccacttctctagcttctttcccttggctcttttctgtcgaatgccaaggaccatagaaaaagtcccgtcgtcaatctccataaaatagcccatgaacgtccaccagtgcatgtactccacagccctgacttcccggccggccaccttgttgaccgcagggaataccagactctcgtcctgctcccaatccattaccttgaccggaggccgcttatcatcctcctgctgcccgcaatccagaaaccacagcccctgcttaattgcttcttccgttgcttccatcggtatgctgtccaggtcttcatatagaatcatcagcattacatcatatttctcagccggctgcagctccgggtcagcgaatgcctgcatgatgaccagcatatcccggaaatctgtccggatctttcgctcttcaccggccacctccaaggtcgtcggaagccggccaatcattttctatacccctccgtgtacttctcaacccgggcttggctggcggagctgaaagcttctatttcctcttcgataatcggcgttacagactgtagcactgcttcaaaaagaaacatcttttctttcccaactgtacacaagggggactggccagaaaagattgtgtcgtagacatcagcattgaacacatagttcaattcacgacgaagcacgtcctcaaaacctctcagttcggcggattcctcttcgtcctccactaccagtgttccatccggattaagttcgattgcctttaagcttccttcccatttccggatgcgtttctgtgcctcctcgacgcgaacacgcatgttcaagtcaccggggttgaaccggattacccggttttcgtccccattgatacaaaatgacttaaatccatcatcaaaattaatactgcgcatacattacctccttatgctccgaccccagaatcggctgtaaatgtctttgtagcaagtacaaacttgccactaaccctgtttccagtgtggtgcacgttaaatggaatctgataccccgtcgtatctccgccatagctggacacttcgatgatggcatcctccttgtaggccacataggtaccttccgctgattcaactggttcccaaagatgtacctccaccacactggtcttaagttcatccagcgtttgacgtttgtctacaatggcctgcagccgtacaaacaatgggtctccgacttctgcgtaatatggatccgtggaagcctgtggctgatagctgtcaagggtaaccgatgtctcacccaaaatattatttttggtctccacgtttgcattcatttctaccgtgtattcttccagatctttcccaagtcgggaatattcggctttactagccgatggaagcgcagaatcaatataatgtgccataaattttcgtttgattttacccgttacatccggcatttataattcctcactttctattttgtattgggcgtatatctgtatctgatacatgacgccctgctctatggtttctcccatcagtcccatgctcatggcattggccgtggacactttcataaatttccccagaaactcccgattctccaccgtgccggatatgccttcctcttccggcagtcgttctagccagtaagccagctccaggagaaaattactgttggccaaccggttataatccgtaaatgattggccaaccgcatacatgacaaaattatgctgccgtatctggtttcccagcaaatcctccttgaccaggctgtctccggtactggacaggccataattgacgggggaagggtccgtgaagtcgatgtgaatgtcatcgccagccagaaactctgatattttcggatattccgtcagtttctgcctcataaaatctatgattgtcaattacttccctcctctgtctatcaatgcctgcgccgcttggatgatatcttccctatggtcggctttcatgcgttcgaagaattccttgcctcgcatcggcgcgcctgcataagtcagctctcgctccgccggtactttaatttcattcttctttgcccaggagctgcctgtcgtcggagacacgtacaatatacctttgtgcaaataatgggcatatggtcccggaatgtctatctgtccggagccgatgacggtggacagtaccatcatgtgttccaattctcctgcctgacggcgcggcatataatcacccatataccgcatagtctcgctgtctatcaccttctgcactggtccgcctggctggattccgtggtttttcaggataaagtttgttgatttaagctccagacttccgttaaacacctcgccgcctccttacttacaggacagcccataatgctgcatcgactcgctgccatacaaccgctcatctaccgtagttaccgttagcagctcatgcgctgcttttaaggccgccagtgactttgacatggcctcctggctgttacagtcaatctcgtctgtaacaattcccttgataacaaggtcttttcccctcgtgaaattaaccggctcagacaggctttccagaggaataaccagaagtacggagcaggcgttccgctgtccggtcttcaggaaggtggcctgctccacatcctcccagtacactcctccaacagggaacctggtgtatttctcgttctttccttccttgctgtacagatacagcgtgcaatctgcgttggtatacatattacaccccctgataacacagaccggtatcagccagccacttcatgatgatttcccgctgttcccggccggaagctgcagctaactcctgagcggaaccgaagctgacagagtaggttccaatcctctcggcagccttcccgccagattctttcagctgcctctccctgcggaattctgcctcggctagttcacaacaacacatctgtacttcttccgaagcctctgacgcatctttcaggcggttaaatgtgtactggtcaatcaaccgactggcctgacgggcgtaaaataggaagccggtgctgatgactggcttccgtcccaggagatagctttctctgtaaaatgtttcattggcataagtcatcagcacaccttcctttctactgcttaatcagtgtaaccgtcttttccactggtgctgcttccacagttacagtctcagtgattgtgccatatccagtcttcttaatcttcgctggatatgttcccgcgcgaaggttaaattctgccacacctgatgtattagttttaattctagatccatttacgtctacaatcgcgcctgcaattgctgtagatgattcatctttgtcttttactgtaaatgtaactttctgggttgttaccgctgtagacggttccaggtaagcaaacgggcagcctacacggtcttcgtccatcctggttgccgggtttggaagcgcccatcccatacggaatacgatacgcagtgcaaccatatcctgctgtgccaggttatagacgatttctttcgtagtcgggtcctgaatgacaccctggtccagaatctttaccgtcacatcctgacggatggaatataccgcctgcttgaagtcaccaacaatcagctgagcgatagtattgtcataagcaccattctgagggaagtacatcggtgccccatccaacgcatagtttgttgaaccctgcatatcggatttaaaaatcaggctgccgtccgttgcgcggatccccctcagcttggccctcatactcatggcagccaaagctccggttgccataaagccgtcctcctcgactttggaaataacgcctccttcgcccaggagcagattgtaataatctggattggatccgactgccacattatttcccgcctgtctggccagtgtgataatatcgttctgccagttacgcggacggttcacaccgaaaataatagcgctgtccactcgctggccgatcgcctcgttgactcttggagtaatctccccgaaaatgtcgaactccgcatcgtccagcacagcctccggaatcggcacaataactgccagctcggcggcttcgatgaatacgttgtcccatgcctggcggctggtctgcttcattcctgtatccccatccacccaataagccgttggcaggaagtcaagaaccctcatgcgggtctggttgctggtcatattcggcagcttacgcgccatgctcatgaatgtggactgcttcggtgcgtcctgaaaaatagttgaaataacctgttcgcggataatggcctccgcgtcggctctgcttgtaatatatactgccatatattgtttacctccttattctctgcccaagatacttctcagggcattgtttgcttgtgtccttgtatcgtctgttttttctccgccaggccccggagtgggtgcaaccactctcggaattgtgacatcctgaaaaaggtacccgttgtccttttttacagcctctaaggccgctttgatatcactttcctggttcttgctggatttcagtttttccacgtccaggaaaggcataacagctctgatatccctaggcttaaatccttccgccgtggatttcagcaagtcattaaagtctcggtctgccaactgctttttatactctgcctctctggttgcaaggtcgtttgtaagcgttgtcactttcgtttgcagctctgatatatttacgccctcaaagcttttcagcgttgactgcgccgtctccagctgccccttgtaagtatcccgctcctgtttgatggcctcgatatcattgccattctcggccataatgctgtctacctgctctttcgccaggcccatgtcctctaaaaatttacgtttcatattgctcctttctcactacgcttttctacggggttgcatcccttgtggtggtagttttacgccgttccgggcaattttgggcgtaaaaatagcacccagggtagtcccgcgtgcttactcctctttgtggcaaatatttgtcagtttcttgtacacatcttcatacaattcttgcttatcgccgttaaacgtatattcagcatagattccatctccgcttattgtcgtagatgcaagacacttataattctgtaaagtcttgcatgaccaaacaataaatacatcgcccaagtcaatttcaacccctggtctattttttctataccactcaaccaatttcttctggcatacattttcaaaatgcttcattcctgtaataatcatataatcctctctttccgttgcgatatcgcaactttttactttggaatcctcagccgctccctctgttgccgcatgtccatctaagagcgcgagacgggattcgaacccgttaaaccaaaaagcctgaaacccttgattttaaaggagtccagtaaatacaatactttacagccgcacaatcatgcggacaaccgcactgaaaaggtgttccgtgttgcattttgcacggtcatgcaacacgaatatgcaacacggaataaggcggccggatcgctcctggccacccttactaccccatcttttttcgtgccaaaagttcatcatatgatacacccaatacatcttttattgcctccaattgcgatgcatatatgtgctgtctgccaccttctattttcacatatgcctctctcgttatgggaagtccacgcaactgcatttctctcaccatatccttttgacggatttgtttcgctttgcgcaagtcgtggatatttttacctatattaatttctgtatcactctttattttctgctccattgtcacctcaaaaagaacccatattcgcacatttttactgattttaactttaaatcatgatacaatgggactaatatcagtccttttagtatggggcaattggtaaaaattatattcatgggagggcaagatgaagaagcttaagaatcgtattaaaaataatatcatgtactactggtccgttatcggccttgccgtaactggttcagtctgccgcattatccattatgtaaaaacagggcgattgccccacaaaaaaacaaagtacagccaagaggagattcggaaggaactgagaaagatcgctgaagaggtcgaaaaagaaaaagaggccccagctgagggtccggggcctgaagagtaggatatggcaaacccctcttctgtttataaaaacgattgaggggtttgattgtgacaaaatattacaaattttgcatattaaatttgcagattgatactttcttttgtttttggtatacttctcttagatgggggagcggtggcaagcccgccctcctctgttttccctaaagcctattctgtaggcttatttttattgctgtctttcggcctccttgattaccttttcgataatctcctttgccttatctgtgtttcctgtatctattaatgcttgtattgaatatagtaatgtcaaaagttcaagtcttgtcatttcttccatttttacctcctctctcctcttgcctggtaactcgttaaggacttgccttccttaactatctccattatactatacgtacgtaattttgtcaactgtttttatctattttctcctctattgcagacaaaataaatgcccttactgattgattgcatttctttgcagccggtgctatgacatcatcgtaatactctttttttacatccagtggaatcctctttaagtttttcttcgcatagctgatgctatactctttttgtttctcatcataagccatattttcacactccttcaactttagaatacctcattttcctctatacgtacataatcaaatttaccaaaattacgtacgaaacattgtgcatcttgtatatttacaattacgtacgtatagtatataatacgctcagaagttaagaaaacagtaaaaatgaccagcagctccgccccggaggtcacgaaggcagaaaggaacgttatgaatacacataggacagttaacggggtcagatatcacgtggttgatgatgcagacacgctgctctgtaagttgcaaaataaggctgatgattactactacgataatatgagatgcgacatagacaaggttgaatctgacatcgatgtgctggaaaaagcaatttctgaaaatgatatcaaaacaatggataagatgatatccgaatatcatcagttgtttaaaaggtaccagtaatcacattcacccgccccggccgggtaacgccgggagaaccatgctgaccctatcggcattacgggggcgggttagtgggcacgtcccgagagttcgccggtatcgtttccgtgaataacgagtgttctcacattccgggagtatgcgtgagagcgaaaggcgcaggcacaaaaacctgcatagcaggcgggtgaaagaccgccccgagagttgctggcttggcgcgctcaaagaggcacggttgcaacgtcatagcaggataaaggagggagattatgctggatagatacattgcaaaacagattatatttgctcaacttgcttcggacggaggcaagaaggacaaagaggtattaaaccgcatttcctcctttgtccctttatcagaagtgcattataagaaagggtatcacacaaagggtcactgtatcatcaatgcgatcagagcaatacagcgcaatccgcagagtggatttagataccacgtaaaagcggatcggacattatacagtggtgcgcatgtctttattgtctattttaactttaagataggagaggagcgctatcagatcagctttcatacatttgacaatatgtggcgctttgtcaaccagcaatgtgtcacgcgctggcaaaaaaagtatagcagcaaagaggcagtgataaagttagtttaccatgtatacaaataataaccgccccggtccgggaataggccgggagaaaggaaagaaccgtgtataaatatattaatataaccgagtaactttattttaaatttaatcgatatccctcttgacataccacccattgagtggtataataaatacataaacaagagataaacaatttctaataaaaaggagagacgaaaatgaaaaaagaatatgcagttaatatcgaatctgtaaacagtgatagagattggaacaccgccgatatggctgactggtacgattcttatgatgaagcgtatgacgcagcagaaaaagcattttctgacccggatgttatggaagcacatgtaagcatttgggaagacggagacgttgacggaaccccgttaaggatggttcgtgaagatggaaacgttcaccagtaccagggcgaaacaagattgtgggcataaaaagggaggggaagagatgttatataccacgtttattagactatgtgatgaagctgtcagacacgaaaacgccgaagagtttattatgaacctcggctggcaggaatggatgaaaaaagcagcagatgctgatgaaatcacaaaggatttgtcactgatttttgaacttgcaagcctggattttccgggcttgcgcaaaagacttgatgttagcatggcgaaaatgtcaacaatgtactggattccattacgttccatcgaaaattgggattccggcaaacgagaaataaaagactattatttaaatttcatccgatacacaatgtttgtccaggaaaaggagggggacgatggatacctcggctatattgcagaacaggattgatttctgcggtattattgttgcagaaagatgtaacccgaatggcgatccgattaatggaaatgtcccgcgacaagattttaacggaaatggaatcattactgatgtctgcttaaaacgaaagctaagagatcgcctttcagaaaatggatatgatgtttttgttgttaagcaagaagaactgctggatgaacagaaaagccttcacggcaaggtaaaggcggagtcagacatggttcgggctgcgaaatcaaaagataggactgcttaccgtaaaattgcctgtgaaaaatggattgatgtccgggcatttggtcaggtatttgctttcaaatcttccaaagcgtcaaaagaatccgaagaagaattaggtatatccgaatgtgtccggggacctgtttcaattcaagacgccgtatctctggattatataaccgtaatacagaaaaacttgacaaaatcagttaattcaaatgaccctaattcaaggtccgataagtcaagtgacacgatggggacccggtatcaaatcaattatggggcatatgtctttcgtggttcaatatatccacaactggcaaaaattacaggattcacgtatggtgatgcactggcaatcaaaaatgccatcataaatatgtttatgaatgatgcatctgccgcccggccagccggaagtatgactttggatagattatactggtgggaacataactgcccgaacggtcaatattctcctgtgaaagtctttcgcaccctgcaattttcgcctatggacgtacccccatattacaagacggaattgcttaatcttccaggattggaacctgaagtgatagaaggctggtaatattctataacatggcaagcccctcttttgcttataaaaaagcggttgaggggcttttaataatcatctttaaaataagcggaccagatgcacctggtccgcttttcaacttaacagaaacttccaatagcttaaatgaagtagttttttcaatccacgcccgaaacgggcgaacagcaactgttaagttgatattacgatacgcagagtatttaatactctggatttccttttattttaacattacagaaccgttttgtcaatgtgacaaaaatcagcaccaatcaatttttagatactgaagtacgcttaaattatgtaccttctggcaatctcgtcatactcagcaatctgtaattccccctggtcatccgttaccatacatttaccctcatttactcccttttccgggcaaaggtaatattttcgtccgtccggcgccgtctgataacctgtcagcatatatccggcagcatcaaacaaataccatgcagatgttcctgttgtaatctccgtcagccagtaccagccgctgtgtgcgtagctgccgtctttgtactgataccaccaacgttttccatcggccgcccgaataaagccttctcgataaatctcaggctctctcgcaaggctccaatcgggtaatccatatcccaggatacgggagtatgatttatcatatgactttgcgcagactccaccaccgttttcgaccacgcctgatgctccggaagtatttccctcgatagttttgaccttactggccgtcacctgcgtcacgataccagtgtgataggcacgtgtcccgttggtaaagaagataaccgctcccggctccggtgttttgctccaccggccggctgccttaaactggttaacccccgtcgggcaataatgatacaacgcgccgcccagcatctttttggccgtctccaggccaaaggcctgtacaaacacatctgacacatacatcgcacaccaaggctgcgcctggagattatgcccggtatgcttataatagtccctggcaaagcaggtgtaattattgctgccagcgttgtccgtaaaactgtccaggtctttattgctcttcttttccaggtatccattccatttcttcgccgtctgaatcaatttgtttactgcattttccatttacattcctctatttgtaaaaaggcccgggatttccccggggcctatgtactgttgttgcgacgtcgcaacaccggtataaccccaccggccggaagatgcaaggatcaccgcccctctatttctgcttgtcaccctgtccataatcgttgctgtcaatcttgtcctttaagaccgcgatatatttaagcagccaatccggcaccgcagcgcccattctgccagcgttttcaatgatagacagtaattcgttcagtaagtaccaaacggccaccagaaggccgaaaaacgcgtttgtcggcattgcaattccaaggcttccagataccctggctattacataatcaactaccatcgccacggcgatcacgcacagataaccaacctttttgatgatacctttagccccttttttgctgctccatccataccctttgtcgtccggatggtcaatagcctcggttttgctggcaagcatgcccgtgatgtagtctaagaccatcatccccattaaaacgcataatacggggtacaggattcccagcttgtcacttaaaaaagcgccggctgctgccaaggctccctgaattgcaattacgtattcctttttcattgtctgtctcctttacttcgccggattctctttcagccatttttcaacctgtggtttccaccacgtttgcacctcttccagcgtcatttctcctgctcttatttttaacccgtaaaatcttcccattatgacatccctcctgcttgttccgctagacttcctgcaagtttggctacatcattgatggccccgtcctgtacctgctgcccctcttcaactactgccacgcgctctgtaagccgttccacatccgttttaggacgcagactataagttgtcagtaccttaccgtcgggggccaccacggacgtttcagacaccagcacaaggtcggtataggttccgaccgtcagcccggcgccgtttttaatctgcacttgcgacaggttgtctggcctcaactgctgccaggtcgccagcatggcagcgcggtcaacggatgcgacctgcaaggcccccaagctagctccggcctccagggcgatctctgtaccgtcttttaaaatcagtttgtctttgttcattgtctatccttctttcttttttattttttgtatataaaaagagccctgaaggactcttgaattttctggttaaatgggagattaatgttattgttccagattttttttgaaggttggcttttttgtatgttgccttcaattaacaatacaaaatggcgagataaaaatctcatacagaagctcagacgtaacgacggagtggatcataaaaaatccagtaagcataggcatcctaacaaaagctgttccaggatttgatttccccctggaatatacatggctttttatcgcaatttccgacggttggggggccggtatgctggtgtttccttacggccaggcaggtagtaatcttgttattggccagtacgacagagcatcccttaagtggagatggacaattaagtaacagccttcttctctcctaataaaatggcgagatgataaaaactgccgatgccacatggtttgataatggtctgaaaattagtattattggaaccccaggggatgcaaattatcgtttatcattccaaagcaagaaaaacaatgtgtggtatggggacattttgtttgataggcatgattagccttcaattaacaatacaaaatggcgaggctattaaatgcatgtttggaatatcagatcgagatttaaataatgccacacacccggggatatatttagtagactttggtgcttccagtgtaaaaaacggaccagatacaggagaatactttacgggagcgttatttattattagctctggcaactttctaattcagttgttttttgatggcaaccaatattttcgcaaaagattttataattcctggactgcttggattaaaaccactcgtgatttgtaatcattaaatggcgatctgtataaatggctaaacgtgacacgcttggatacgggtaacgatgtaaacgaccttcccagcccatccttggcctattcctattcgacggcatcccatgcgccgtttgatggcatcagtgctaatatccttacaataggtatagatggttacaaagcccaaattgcctttggagtatccagggatagcgtacaagtgaaagtacgaacttcgtacgattttgtttggcggggatggagaagcgttacgttatcttaaacaacaatgcaaaataacaatttaactgccaaaaccttacgcaaatttgcctgtttttcatcgcttgtccccagccgcaaaaaacattatgtcacctatcctattttggggtacaacaaataagccaccctctcggctgactaaaaaaatgctttccatcaccccttaggcagcatatttacggtaagattcccggacattatcctgtttgatattacagtaaatcaatgtcgtctctattttggtatgccccatcaagaccattacttcttcgattcgcattccgcgattcagcaagtcggttgcaaaggtccgacggaaccggtgtggatgcacattgccgactcctgcctttttccccaactgctttaccagatactgcactccagccactgttatacctgtatacggctttttcacggccgcaaacaagggcttctctgccaattcttctactgttagtccctctttttgcatcctttctttgaaataccggaacaggtggaagcatgccacgtctgatatgtacagatgtctctctttccggccctttcccatgactttaaactcctgtttatataaatcaatatcgcctacctttaagctacaaagctcactcaccctgacaccagttgcatataaaaattcaatcaacgccctatcccggctgcgggtacatgacagtctcaatgcctctatttcttttgccgaaaaggcttgttttatagtactttcaatacgtaaactttctattctggcaatcggattttccgataccatgttttctttttgcaggaatgtccagaaactgttaaggtatcgcatcctcccctgcagcgttaccatactgatattgttatgttctctcaacattccgaagtaccacctcaaatccatcgttgtaatgtcctcgatatttttattcaaggcgtttcggcagttgcttatttcccttacatactgggccagtgtattgttctgccggccggatacttttttactggcaacaaacaacctgattttagcagtatcgctatccgttccagttgcctgcagctcgtttttttcttccacaatttttttatcgtggaactggatataaagcacattttgaagcttatccaactgttcttcgtccagacagttactcatcgcctggacaacattcatcaacatttcctctaacactcaaaaacctccttcctgatatctctacaatatcaaaaaagaggttctttcgccctgatttttgtaagattttctcagctaaattgttatttcagattctggctggtggttatcccttggggacgttgatgtaatatacccttacggtatgtgcggttgttgaattgataattagtctctcgttaatcaatatatacccgataatataatcattgtttgacattgatgccataccggttacgatattgtcatatgcatttaattcgtctgtctctgttttccctttctggcaggttacgtccaggaatttaattttcagatcgccatttaatgattaaaatcacgagtggttttaatccaagcagtccaggaattataaaatcttttggaaaatattggttccataaaaaacaacgaattagaaagttgccagagtaataataaataacctcccgaaagtattctccttatctgtcttttttcggaacaaactaaaaatataccgggggggattatttaatcaatatccaaaaattaatcgccatttaacttagtaagcagattctcagctgcagtaagtcgatcccctagtgccttacccatcggaccggacagaactgtggatgtatctgttgccagaaggttatttacaatcttagcagcgtcaattttggccgaatcgagagactccagggctaagattgccgcgttcgctgcatccgtgacacgctttagtgcttgctccgcgtgatttagatttgtttcgtccaaatccggctccgaattatttacatatattgttgggacataagtttcaattggatttatgtttatactcatatttcctccttattcaaatttgacagaatgtaaaaacaatttaaaggtatcaaccgtaaatgatacgaacagactcaaataagcacttcttgatagcgcactaacatttatctccatagttctaatcgtacccgaagtatcttttttggtaatctccactgattgtgatgctatgctcaatctatccgttgcttgatatcttatatttttttcacgcgtaataaatgcttcaaaatgtgttgttgcgcttaccggcatgtagaccgaatattcaatcactaatttatttacatatgtcaggtcaatcggagcattaaaaacggaataaaccatgtttccaccactgctccccaacttaatggcgtgaaattccatatattttctatcttctatcctatctgccttatagcttccataatcgtaagcaatatagtctgatatggattgccctggagcgaatgtgccacgatagtaaaaagtctttgggtcagttacaatatatccttgccaggttccgggacccaccccacctacatattcgcccagcttaataatctcagggacaaggttgcttagcttgtccacgatgatattcccggtcatatacatgccgtctgtgtatacggtaatctgcttactgccaggggtaatatgtgtttcttccatcgtcgggatactttgtcgtacttctccgccatcatattttccggccggaagagtcaaccttccattcaaatcaatatacagcgtcggcgaacgccgatcctccatctcccccgcatgcacctggccgtcgggtcccacatataacttgcctttcaggacgtcgccaggcttcacatttaatttctcaaagtccgcgctctgtataatcatgtcaagtaatccatccgccatacttcatcactcctcatccggaaagccctgataggttccaacaatatctcccaccggcacaccatccttgattacctctggccgcaggttctcgacgctcattatgattgtgttggatgtcagcaccttgccaatgacgtttaacgtaatccctccggctcctgggtcgatcgtctgtcccgtttccgttttaactcccgtttgtcgaaacacatcttcgccaccatgatacccgggtacgatgttgtatctctcgttgatcgccatatcctttgtgattgcaggtattaccggcatagcaccttgttggggctctttgctgccggcgcccaaaaactttatcggctgtttaacatcggccggaaccgcagtcaggccagaattgtcgaaaccagctccatgctttaataagactccatcagccattacttacccctttcgcggacactgtaatactagttccaggttttttgctgtaacaatatgccgtcacccttccgtttccggatgcgatgcgatctatgtagccccaggccagtttctgggcctcaacagtcacgttgcttagggttccagtcagacgcaggccgtataccggtgtgtcagactcttttatccctgcaaaagaaactgtctgcgtatacggcgccgtgctgctccatccggaagcagaaaacgatagcaacgtctcccccacaaaggctccgacttgtgtctccaggttttggacgtcttccataatctcacttcggaacgccgtattgtccttatcaatagcgttgactgctctattggtggcgttaaaatcatcagccgaaaaaatatctccctcctgcgtgtagacagtgacatcgcgcagagatatagttccgtcttcattctggaccgtctgatattttcgatttccctgatagatatcattcttgtaattttctttcagactcacagtttcacctccctatttcccagcgcccgggtgccaaccttaaaatcaaaatgctgcatccccggagaagaccgttctaccagtacgccaatgtcatggataatctgttcgataaaattcgcctggtaaatggaggtatatgtgatgcgttccggagtttgcggcgtactggacggcgtgtaataggctgcccgtattgctgccagattgtcccgcagccgctccatctcactgtctgtccgtcgatcctctggcttccagtttactttgttgtgggtttcgtttcggtatccatactggtttaagacgtgggatacccacttgatcgccagctcgattcgatttaagtcctggtaatcaatgtaggccttcgtggtcatatcctgtacatcctgcaccgttctgtcatatataaggttgtctatatacttactcatggatagttacctccgcgcggatttctcgcaggctgaattgatagtcaatgctttccaacgtcccggttcttcggccatcatagccggtatcaacgcctaccacctggccaagcaccttatccgccagcagcacatcgccgaccacgttttctgcccgttgatagtattcatatacccggtttagtatctcctgggcgtttccagcgtgcaccaacgtcgcgtctgatacttctttaatatttttattaaaggcaatgttgggattttcccgtaacattgatgatgtcatgtgattgtattttttaccagtcagcactaccactgcaccggttccggccacaatggcatagttagcattgctctctatgatttccccgccggtaatagacaggctgtggtgtggatcagaaaagataatctctgccctgccagataaaacatcgttgtatagttcctccacctcctgcgtcggctgccaggagtgaacggtcagccgcacaccagtaaccacatcgttatgctccaacgtcagaccgtcaaaggtatcggcagtggaaaactccccacttaccgctgtctgctgtggatagattaagactccatcatagtttgatgtatcgaccacggcaccagccgcaaaagccagctgcacaagcgcgttgtgtttggtcgtgtaggggatatgaccatacaacgggacggaaacaagagtatcgtccaggaggtaattaaagtcctcaccagaaaacagttcctctagcacggctcccagctgctgtccggtgtaaataccgccgtggtactcgctgccgtccaggactccaatcgcgtcgtgcgtgtccatatagtaatccgtcttattttttctagccccattttttaaataaaaacttcccaatcgacggccattgaagaacaggttcagtttctgcttcttctggaaatcaaacgggatgttagaacgtgtccgggccgtgaatgtcatggtgttggtgctgacattttcagaaatggcgttgatttcctgttggcaggaaatttcgcttatttcatccccgaaaaactccctgtagattccgtaatcgattcgggtcacaaataccggccggcgtggcctggatgtctcaaggaaggcgattacaatcttgtcataagactgtacatagttgctacaaaaataccgttccgaatccggcgcgaactccatggacgacaacagttttccgtctgcataccattgcacattaatttttgtacaataatcacctgacatcaaattgaatgtaattaagataccaaccgaagtaaatttctggctgaataggacggtcagctccgggttacttaccttccgctccgacgttttggccggaaaaaagaatggtgctggccgaagcccgggccgtggatgcagaccgactgtggtgtacgtgtgcgaaaactgccggtcttcccctgacaattcgtcgctgatatatccatagtcggacgcattatccgggaagttgacatattccccgttcagcagggcgaaccgtggtgcgcaaatggaatatcccggataggtcaggtcatcccgttttaagtccgggaactcctggcggacagtcgttgcccgggggtataatttcgttcccgggtacagccccttcctgggccgcaggccaatgtcaatcacctgcggctgactgtgttccttggcatacggggctacgtcgtcatatacaattttaggcccttcgctattctcgatgacgtctgataatatggtctgttttagaaacatcttacggcctcctttgcggcgccatcgccacgaaatacacagacaagccgctccacagattctttccatcaatgcgtttcaagctgtccttcccctgcgttacgtaggccttaaactccagtgtttcctgaccatatgggaaaatcattcggtgggactcaaccggggcggagataatattgtaaaacgtgtcatagtccgcccggtgttccgactccggttcgacttccagcgtgtagttgtaaaacgttcctgcaacatccctatgcatactaaagtcctgcgtgcggccggagttttccgtgtcagtgaccgagaacccgcgctctagtttaatgacgttaacgcgaagttcaacgccatcaattgaaaatatgctttctctcatgcttatccctccgttaccagtcgaacaccgacacgctgcttctgctcgttgtttagcttatataccacccggccaagacgctggcggtcaagatacatgtttacttctatctgacgatttcctccgtctccacccatgtacttagccattacgttgtccagtgcctgttcaatcgtcgataacggcgagacaacctctgtctcgcgattgttgtcccccaggatagccgcaaactcgccggcgcgtggcggaaccacggtgccagtggccaggcgagggattgcctgcgtagccaaattatagccctgaccgatataactgctagctctactgctgtattcgctcgcgctgcttcccctcgtcagcgcacttatagcaattccgcctaatgtgattcctgctgcagctgcaacaataaatcccattgctttcatagtcggattcatcatgatactgcccaacgcgatagccaacaaaccaactgctcctgccacagcgatgattttcgtggccagtttttcttccggggtcattttatcccacgcttgggcgacaagcgctgccgaggtaataattagcccaagaagcagcgtcagggggtcaagttttccgattaggcctcccagcgtgccaatcaagtttggaagaaccgtcaacatattcttaacacccgttacaaattccacaaacttaaatgcggcaaaaaagcccaatattactgtggccattatttcaaccagttcttgattttctgatatccacccagaaaatttcttcaaccattctacaattttttcaatcgccttgataaatacctctcccgtccattttccaaacggctgtaaaaattcctcccacagccatattgccaatggtttcaacgcttctaacactgcgtcaaatgcgtccagtgctgccgctatcaaatcaaatgctgccggaagaccattttccagcccccacttagcaagcggaagaagaacatccttcaatagccataacagaatatcccctattttgcttacaattggccgacttgaaaccagaatcccgtcaaaagatttcagcagtggtgaaaaatccagcgtagccgaccatatcttaatctcccctgtcgcgtcgcggaagaatccggtcacctccaggagaaggtcacccagatgacgcataataagtagccctgtatccccgcttttccatgcctggtcaagcccatctgcaaggttcccaaccgtataaagcagatttgatacagaaatcaggacatcatccgtgatagcctttccatagccttccttttcccaaacagtcataaaagactggccaacatcatttccaagatttttcaatcgaccaagtgcaaattccgcagccgaaacaaccgtcgctccattttcatcccaagacttccgcatcgggtcgaacagacctgacagcactcctttaactgtctccgcaaaatccttgatatcagcctcaacctcgactgtctcaaacatctggtccggtgtcggagatttgtaagcatctgtatccacttttccgccctgcgcctgaatcaaatcatcaaaggcaaatgccagtttctttgtagccttttctttctctttcagttcgtcatttgtttcctttaaggatcctgcataatcctcctctacatccacagcctttacaaaggtgctttttccggtcaacgccgcgatgaactgcccggcgtaggtggccccggtagaaagcaggtctatcatttgtttcaaagccggtgcagctacctgtagaagtggcgcgaaggctgttgcaaagctgttattcaaacgtgtattagctgacatcagaagggatatgcttttgttcgtttcatccgaatatctggccaaattctgaaagccctcctgtgccgatttgatggcggctcgtagagacattcggataagcatcagtttgaacatattggacagcttcaggacactctttgttagcggaatagcttctttcctcatccgcttcatggaaccactcatcttactggcggatttaccggccttcttttgtgtattgtccaccccaatcagggattttttataagcctcagctgcctttttagccaatgcaagacccttgtatgccttgtcatactctgggtctcccaggccaagccctttttgctccgcataatacagagcatcctgataacggtccacttcgtcctgtaatgtccttgccttcgttcttgcactgtccatcgacgcgccggcacgttggaaaattgccacaatgttatccggaaagtgcttaaaggactccacggcgataagcaaagagtctttcagccctacaacagaattttcctctttctgggtttcggccgttacggtagccgatgcctgccttgccgattcctccagttcccgatttttcgcaatcatagcatcgacatcttgtccgtaaatattgtaccgcttcccatcatcgggaatggtagacgcaggggcattgttgtttgtaatcgttcctgtaaaagtcgcggctttctccttctgaagtcgctccatctcttctcttgtttttctggccgactcggccacctcatccacctgtcgggccgtcgccgctgcggcagaaccggaagacgaaaaggccttatccatttttgttgacaggttatcaatcgccgccgtaagcttttccgctgcctttaaaaggctgcctgtgccttcttcgaatccgtcggtatttatcttcgtgtcaaactttaaacttccgtcagttccgccagctgccatactatcacctctcctccgggcataaaataagacgcctgttcagcgccttaacccaataacttattccaataatcaatttcttcctgttcctcggctgtgtatttcttcttcaaatcacacagggccttgttattgcggtaaaattcctgctcccacttctctagcttctttcccttggctcttttctgtcgaatgccaaggaccatagaaaaagtcccgtcgtcaatctccataaaatagcccatgaacgtccaccagtgcatgtactccacagccctgacttcccggccggccaccttgttgaccgcagggaataccagactctcgtcctgctcccaatccattaccttgaccggaggccgcttatcatcctcctgctgcccgcaatccagaaaccacagcccctgcttaattgcttcttccgttgcttccatcggtatgctgtccaggtcttcatatagaatcatcagcattacatcatatttctcagccggctgcagctccgggtcagcgaatgcctgcatgatgaccagcatatcccggaaatctgtccggatctttcgctcttcaccggccacctccaaggtcgtcggaagccggccaatcattttctatacccctccgtgtacttctcaacccgggcttggctggcggagctgaaagcttctatttcctcttcgataatcggcgttacagactgtagcactgcttcaaaaagaaacatcttttctttcccaactgtacacaagggggactggccagaaaagattgtgtcgtagacatcagcattgaacacatagttcaattcacgacgaagcacgtcctcaaaacctctcagttcggcggattcctcttcgtcctccactaccagtgttccatccggattaagttcgattgcctttaagcttccttcccatttccggatgcgtttctgtgcctcctcgacgcgaacacgcatgttcaagtcaccggggttgaaccggattacccggttttcgtccccattgatacaaaatgacttaaatccatcatcaaaattaatactgcgcatacattacctccttatgctccgaccccagaatcggctgtaaatgtctttgtagcaagtacaaacttgccactaaccctgtttccagtgtggtgcacgttaaatggaatctgataccccgtcgtatctccgccatagctggacacttcgatgatggcatcctccttgtaggccacataggtaccttccgctgattcaactggttcccaaagatgtacctccaccacactggtcttaagttcatccagcgtttgacgtttgtctacaatggcctgcagccgtacaaacaatgggtctccgacttctgcgtaatatggatccgtggaagcctgtggctgatagctgtcaagggtaaccgatgtctcacccaaaatattatttttggtctccacgtttgcattcatttctaccgtgtattcttccagatctttcccaagtcgggaatattcggctttactagccgatggaagcgcagaatcaatataatgtgccataaattttcgtttgattttacccgttacatccggcatttataattcctcactttctattttgtattgggcgtatatctgtatctgatacatgacgccctgctctatggtttctcccatcagtcccatgctcatggcattggccgtggacactttcataaatttccccagaaactcccgattctccaccgtgccggatatgccttcctcttccggcagtcgttctagccagtaagccagctccaggagaaaattactgttggccaaccggttataatccgtaaatgattggccaaccgcatacatgacaaaattatgctgccgtatctggtttcccagcaaatcctccttgaccaggctgtctccggtactggacaggccataattgacgggggaagggtccgtgaagtcgatgtgaatgtcatcgccagccagaaactctgatattttcggatattccgtcagtttctgcctcataaaatctatgattgtcaattacttccctcctctgtctatcaatgcctgcgccgcttggatgatatcttccctatggtcggctttcatgcgttcgaagaattccttgcctcgcatcggcgcgcctgcataagtcagctctcgctccgccggtactttaatttcattcttctttgcccaggagctgcctgtcgtcggagacacgtacaatatacctttgtgcaaataatgggcatatggtcccggaatgtctatctgtccggagccgatgacggtggacagtaccatcatgtgttccaattctcctgcctgacggcgcggcatataatcacccatataccgcatagtctcgctgtctatcaccttctgcactggtccgcctggctggattccgtggtttttcaggataaagtttgttgatttaagctccagacttccgttaaacacctcgccgcctccttacttacaggacagcccataatgctgcatcgactcgctgccatacaaccgctcatctaccgtagttaccgttagcagctcatgcgctgcttttaaggccgccagtgactttgacatggcctcctggctgttacagtcaatctcgtctgtaacaattcccttgataacaaggtcttttcccctcgtgaaattaaccggctcagacaggctttccagaggaataaccagaagtacggagcaggcgttccgctgtccggtcttcaggaaggtggcctgctccacatcctcccagtacactcctccaacagggaacctggtgtatttctcgttctttccttccttgctgtacagatacagcgtgcaatctgcgttggtatacatattacaccccctgataacacagaccggtatcagccagccacttcatgatgatttcccgctgttcccggccggaagctgcagctaactcctgagcggaaccgaagctgacagagtaggttccaatcctctcggcagccttcccgccagattctttcagctgcctctccctgcggaattctgcctcggctagttcacaacaacacatctgtacttcttccgaagcctctgacgcatctttcaggcggttaaatgtgtactggtcaatcaaccgactggcctgacgggcgtaaaataggaagccggtgctgatgactggcttccgtcccaggagatagctttctctgtaaaatgtttcattggcataagtcatcagcacaccttcctttctactgcttaatcagtgtaaccgtcttttccactggtgctgcttccacagttacagtctcagtgattgtgccatatccagtcttcttaatcttcgctggatatgttcccgcgcgaaggttaaattctgccacacctgatgtattagttttaattctagatccatttacgtctacaatcgcgcctgcaattgctgtagatgattcatctttgtcttttactgtaaatgtaactttctgggttgttaccgctgtagacggttccaggtaagcaaacgggcagcctacacggtcttcgtccatcctggttgccgggtttggaagcgcccatcccatacggaatacgatacgcagtgcaaccatatcctgctgtgccaggttatagacgatttctttcgtagtcgggtcctgaatgacaccctggtccagaatctttaccgtcacatcctgacggatggaatataccgcctgcttgaagtcaccaacaatcagctgagcgatagtattgtcataagcaccattctgagggaagtacatcggtgccccatccaacgcatagtttgttgaaccctgcatatcggatttaaaaatcaggctgccgtccgttgcgcggatccccctcagcttggccctcatactcatggcagccaaagctccggttgccataaagccgtcctcctcgactttggaaataacgcctccttcgcccaggagcagattgtaataatctggattggatccgactgccacattatttcccgcctgtctggccagtgtgataatatcgttctgccagttacgcggacggttcacaccgaaaataatagcgctgtccactcgctggccgatcgcctcgttgactcttggagtaatctccccgaaaatgtcgaactccgcatcgtccagcacagcctccggaatcggcacaataactgccagctcggcggcttcgatgaatacgttgtcccatgcctggcggctggtctgcttcattcctgtatccccatccacccaataagccgttggcaggaagtcaagaaccctcatgcgggtctggttgctggtcatattcggcagcttacgcgccatgctcatgaatgtggactgcttcggtgcgtcctgaaaaatagttgaaataacctgttcgcggataatggcctccgcgtcggctctgcttgtaatatatactgccatatattgtttacctccttattctctgcccaagatacttctcagggcattgtttgcttgtgtccttgtatcgtctgttttttctccgccaggccccggagtgggtgcaaccactctcggaattgtgacatcctgaaaaaggtacccgttgtccttttttacagcctctaaggccgctttgatatcactttcctggttcttgctggatttcagtttttccacgtccaggaaaggcataacagctctgatatccctaggcttaaatccttccgccgtggatttcagcaagtcattaaagtctcggtctgccaactgctttttatactctgcctctctggttgcaaggtcgtttgtaagcgttgtcactttcgtttgcagctctgatatatttacgccctcaaagcttttcagcgttgactgcgccgtctccagctgccccttgtaagtatcccgctcctgtttgatggcctcgatatcattgccattctcggccataatgctgtctacctgctctttcgccaggcccatgtcctctaaaaatttacgtttcatattgctcctttctcactacgcttttctacggggttgcatcccttgtggtggtagttttacgccgttccgggcaattttgggcgtaaaaatagcacccagggtagtcccgcgtgcttactcctctttgtggcaaatatttgtcagtttcttgtacacatcttcatacaattcttgcttatcgccgttaaacgtatattcagcatagattccatctccgcttattgtcgtagatgcaagacacttataattctgtaaagtcttgcatgaccaaacaataaatacatcgcccaagtcaatttcaacccctggtctattttttctataccactcaaccaatttcttctggcatacattttcaaaatgcttcattcctgtaataatcatataatcctctctttccgttgcgatatcgcaactttttactttggaatcctcagccgctccctctgttgccgcatgtccatctccttagagaaatccacataagccttattggtcagtctcaaccgacacttggcagccgttatatcatccttatcagctcccgccttctccaggagttccacgtcctgtttctgcttccggatggttcgctctaacttccgctgatactgcaatgcgctataggtgtcatactccttcccccggaatgttttcttctcattctctttccggttctgttccgccaaccactcatccgtatacttccgctttgatatcccaggcaggaaggggaacttaatatgatagcagttaatgcctgcgaaacctagcatctcaccctcgccgcagacagtccgcatctcctcagaactgtataccttgccttgccagctctggtgattaaggtacccagtacctgtgttcctggcgcccatgtgccagtctacctcccaatggtccgtccccagctcctcagcgttcttgtcgctgacctgtttggtcatctgggccacaccggtcatcactgcacgcctggctgccacctctatgcggtctgacttcccggatgcataatccacagtccggatgccgctggccgtcatctcgtcaatcacctcacctatggcctggctgtacgtcctggtgccggtagtgattccaagcattgccttatccaggctgcgctccagatattcggacagtggcgtaaatactttctttccaccgcccatcggcacattaaaacccgttgtctgggtgatattttccaatggcctcaagctgtccttggtctgccgcctggcagcatccacaacctgctgcagccattggttgtcctcatatggctgatagtcaacaccggcagcctcatatatctctcggttgcggatgtaatcagatcgagcagcctgcttgtagatatcatccacctgcagtccagcttgtttgatggcctcctcaatcatccgtttgattttggacttactaacgccgattgcggtaagtcggttcaacatccagtccgttaccggagtaatctgtgcggatgccttgatgcgctgtacaatctcattcataattgacagctccagggttgtcatggttcgctcaatcggttttggcagcttctccagctcttctggcgtcatttacatcactcctccgtcagtgccggttccggcaggttcttggccgcctcttccagcgtttccccataccacttagcgcggtactcatccagcctcatgactcccatcgccacgtcattacgatcctgatttcggtcttcttcggtatctactatgacgctgtcatcccagtcaaaagacacctcgtagtttccaccggctggaactaatccataaagttccgcccaaaagcgcatcgcatacaccagatcctctaacgcatcttgcaatgccatctgcgtgtctgataccatcacgtaggatcgctgcttgctggtcttgatttccgtggctgtcttgtccacgctttgcgggtcagacaacgttccatatgccaggcagcagttaaattccactaatttcagctgattattaaagccattgaacagcgcagtgtctcggatttcaggagaaaaggtatcaatgaatggtttatcagcagcacccgtgttatattccagattccggtataggcgctcctttcctccggggtattcaaatttatcacgatcccggttgtacttaagcagcgacgtcgcgatgtgtaccgcaagctgtgtgccttcgtattcccagcagatgttcgaatatcgtttgtctgcctcattaatcaggccaatcgcccgagaatacaccgatacaccaagcggactgtcggaatcgtcagcattcgcaagcggtaccttaaaatatccaaacagcagacggtccgccccttccaatgtgacctccggtgccagttctgaccatcggtcaatgctgttgactgacacttcgctaccaaggctgtagtcgttggtagccacgaatgcccggtttataatccggattctcccggcctgcatggagtgaatctctaatcgggtatatatcttctttcctttccgaaactgttccgtaaatacgcactgtgtaatccggctggaactatcgaatgagatagggaagaagcaatcggcctgaacgaactgcacttcgataccgtgttgggtgatatacggcttcatgaccaggccgcccttggcacatccatattcaacataccgccgtatacttttcaggacttttcgcttatattgttcatccagatacccggagtcattcccacctgtgatttctgatttcatttctagtgtcaccagtcgggccagctccgacgcgatagccggtgccaggtttgcactgaacacatccttgttgttcacccagggggaccggttctcatacatccgggtccacagctctatctggttcgccatccgggatgtcaggcacacatccacctgcgtgtccgcatccttattcaggacattcgtgattaagtccagcatctttgtgaatctcatcgtcccatcacctcctatccatactttatgagcctgctaatctgccgttcaaacgtatactcaaagctgtccaggctgtcaatatcgcttgtaccatcatctaaccggacattcttcgtcaattcctttgggtcccacactgcagtactcaatgcatccacaaggctctggcactcgccctggacataataaaaacgcccctgggccatcaggatggcggtagcgttaatcctgtcattgatttcagttttcagggcattctctacacggacccacccaagtccatgtttacgcaggctgctccggatgccagctatcagcgtctgctctgcgctgtctgcatacactgttgtgatgtacccgtgcctgctgattatcttctggcagaagttacagaacattgtccccagcatttcggggtcaatctctatctggttccccttctcatccttgcaaccaatccattctgatgccagtgcaaccacgttatggtatcccctggtgatggccgtggccgtgaaggcatggccggaaccactgccgccgaagtcaatgccaaggataatctccatgatgtctttgggcttatctgtcaggcggaacgcgtactgcctggtacttgtgtcgtcagcaaaccggcggtagatgaggccattggccaccacgcgcattcccttgatgtcccggaggtaccagatactgtttttatcataccggctttcgacctcccgcagacgctccggggtgatgttgatgttgtcgtagatggtacagtgcatgtagttgtatccacccgggaagtcccctgcatccgcctgtcgctgatacttgtctatatactccgcatagatgggcgcccttgggttatcagggttcaggtcccagaacaccttcaggcgccgggcagccagctgacggttgaatgcctccttgatggtgttatcgtgatgcaggttaatctcagttgcaatccacataccgtaggagtttccacgaatcttcttgtagctatcttccttggcggctcccgcaaagattactatcttctgttttccccttgtgtccgggcccttgataaacagcgcctcattgtctttgtacttcccccagtggcattgcccccggaatatccactcaagcccaaagccattggcatcaccaatgttaagcttcgcattggccatagtggaaccggtagccaggtgaatccggtccggtgtggttttaaactcatgggcgaaggcaaacacgttatccactgtcttgccggcacggaccgcaccctccgccacgttatacatgcaggcctcgcacctacgtatataatccttgtgcttctcggaaaagttgaatgggatggtctttttcctgacaaaactatttactgccgccatagatatccccctctatcccctccatgtcctccagctcctggttgttcccagttaacttatccgtctgggcccggagctgtgcaattcttgctttttgctcctcgccggccagttcccagttcttgtgcaggagctcgtcatattgcttgatgagcccttccagcgtcttctgggctctggcctgcgcctgcaggaaattgccatgcttatcccaggcctgctgtacttcccggcgctcctctgtgaccgtctccccattcttatggcctatcttagtgatggtcacgtccttctggtccctcacatacatgatggactgtgcccggatgatggcggcataggctatctgtacctggtcccagagaatgtccagcgggtccgtgggcatctcctggatgatggaaacggtctcctccggaagatatttcgaaaagaaaccgtatttttctgcgttcttatttaggtcaggggcgccaccttcattcccaacagcgttctggttaccgggctggcctcccttctttctttgcgaacgttcgcttttcttatccgaacgttcgttgtcccatttgtgtgtacacttccagcggcggaccgtcccctctggcaaatttagttgacttgcaatctcaactaatttcctgccttccaggtacatggccttcgcctgctcaattcgtggatctggcgctcgggccatgtttctcacctcatttcgtgttgttttgggtatagaaaaagagccacgggtgggtggctcctggttctagctataatatatctactttaatgttctatctatcactataaatatcctttttaacaccataaacaaattcattataagcatatttgaaaaccaatatatcaaaatgctttgcagaaatgaaaattttgcagtaaatactgctacaaaacacaatatgagtagtattatagaaagtaatatctcaaacatgaccgcataataaaccgtctgcaatattctccctattacgctcatttcagaagagcttttatttcctttattctctttccatcttgctttaatatctatcactatcgctaataaagtaaagaacattgaagttaaaacagaaattattaatgtaagaatatttatagtgtcttcatctactattctaatctttgcaaaagctcccgcaaaaaaaacaggcacaataaaggctattacaaattgaggtttattaaatttattatccttttcatttctaaatgcatctacatggttaacaataatattagttatattaaagtaattcgatttaaaaattacttttgagataaaaagcactagaaaacatagtaaaatccaaatagtgggatcactcacccccctcaataatagtttcatttgctttcacctctttattcgaattattttccttcaccatcattttatattccatgttttcttgaagcgttataagtcccatatcagaaagatattcccgtgaatactcttcaaacaatacaatgattgattctttttctggattcccgcctatctttgatacaatttctgtaatatctttcacgacaacggttttgtcaatattcttcatactaacagttctatttttcccagctatactaaaaacaaatttcaaatcatcatagtcaaaatctggaaattctattattttatcatatgcccttttcccttgcatgcattcatgaattttatactcatttctgctcagaaatcctacaggattcataattgtcagtatttgctttgctctcttaacaccccggttcattcctacacgatctgcgatgtcatctggaatagcatattgaatcatatttattttagccagtttcccctctcgcatatatgcttttataaactcctttggatataaagcacctaaacttagtgttaaacctatatcttgcttttttaaaaacgccttgaagtgttcttcgaaaatagtcttaactccgtttcctccgatattctgaaaaatagctatggcagttgttactccgtcatctttctcacaatcagcaaccgaaatacaaaagctgaacggaagaactggagcctccttcgatgtaatcttgtgcgttacttttcctgtttccttgtccacaagttcaccctccgagccataactgcccgatttaattctaccataaagtagagtataaagcttattgctattttggtcaattattgtacgtatatcccaatctgaaaatgcaaatatattttcgttgccttcttcatcaacataattttccatattgttttcgataaactcttttgcaaaatcaaacagactttttccatccttcaaattatgtaactcagcatcttctccacggaatcttaaaaccctcagtgaataaatagacaaaccaatagacggcattgtgcttctctcccatcgacatttttttacattataccacatcctttctggaaattcttcccatattattgacgcctattttgtataatcagtatagaacatatgttctaattgttcaaataccaaaaaggaatagaaaaggcactcagccataagccaagtgcctaatccgtatctggaaatgtctttgggagataaaaccagatacaagcggcgcatccggaatcgaaccggaacccagggcgcgcccctgtccacctgccattggtgggatgctccacatgtgccggtttcccggcatagccctgtattgtttttggtaaggtcaattaagggtaactttttgaccagtccgcattggcatcagcagcccctcgcaactccgcccagggacgtctcccatgttccttcgctcggccactgtttccagcttgcgcttcaccgtactttagtcggccttgctatatacttatcactgcctgcctcgccggctgacatcggagaggatttctttcatcggttccccctgcggtgggttcaccttacattcgcattttacatatagtgccggacgcgtgccctgcggcattgcccgttaatagagcctggcttatgaggggttacgcgataccggcgaatcgaccaccaggctgttacacactggcgaccgaaaaggggaggggagccgctggctttaaggcctttggcttctattgtattctacaacgacctttccgacttaaacgaccttttacttaatttggcacttttttaaatagtcatctctaatatggagccgcggataatctggactgttgctatatccggtctttgccgcaatcctgtcccatgtcatcccattaatgtaaaacatcttaaatacacatcgtgtttgcccgtcctctatggcctcaatccatttttcaaccgctttgaccttatcctttttcccatccaataccttctcgcgatgccctcgcagcttccagtcaaatcccacaacgctctggggtatcgcctctccggtccggtaatcaaagattgtgctgttgtcgaaaccgttatccccctgcagcatctcgaccagctccagctccaggagaggtatttcccgcttcaggcgccggtaatcatccagcagcttcctggttatcttaattcccactggcaccacccccattaatccacaaatttatttcgaccacgcttgcgccggtattggataatctgaacgtatgtaatggatgtcccacaatcaagtatcacaaagtgcggatacttagccgtcacccggccacgcataactggccgcacaccattgcccttctcacatttccaggcgttgtcggccacattaaacgcatctcctatcttgacccgttgtctgcacttatcaatatcctccaggaaaatagctcccattaaggccagctctgttttgctcttatttttgattgtcatcgcctcctatctgtccaccagtgttgacccgcagctctggcaccggacatagcaccgtgtaacaatatgccggcatcaccgccgaccaggtctccggccgtggccccttcaggatgtagtcctgggcggatgcccgacggcgccgctgctctgccacttttatgtaatctgtcttgctcgttgtaatcccccctttattcctgctccaccgctctgaaatcctaattatctgtatctgaaacaagatattcgcatggcctatcactcccataacagccattctcgcataccatatagttactgcacttcttacattcttcgcaaactatcataattacctcctggcttaaatgctaataatagcaatgacactttttacaatcactcttctggcaccggtccatacgaccaggccatactattactttcccttttgcatgacagcgcctattccgttttctcttcattccccgtcctcctctttcgccgcccaatccttgcagtcctccacatcaaactcatgcgcccattggcattcaggttcaaatttacatgatacacatggaccattggctctgtttaacaatgccggctttcgtagctgctctaactgctttgcagcccactgtaatgttttttcgttcatagcgttctcctcaaaatgtcaatttaacgtactagtaaccctctctcgtcctgcatttcatcatgtattttatatattgtttctgtgattcccttggcttcgttttccgcatgggccttagaaattcgcaaaatatgtagctcgacaagaaaagcaagtatctgctcgtcatctgcactccatgtattatctttctctctccggtccttcatatcacaaatcttttcattcaatgcgggcgtcgataaaagtgatctcatatattactcctttaaatcctcattttatgaattaaatggttctggtaatggcatccatgcgataatgtcgtcttgcttaatatccgttggagttacatgccatttttgcccgtttggaccataccaagctatcaaaatccacccatttcttgtgcaaaccaaaacatcttctttcgctttcggcaactgctcttccaccgggatccatctaaacaactctattacttcatccagcaaccatatcgagcgtagtaattcatcatgtgtcatagctgctctttcttctctcgtcggtttaggtgttctcaatgtcattctatccctcctctaaatcctcagttttcaaacactcccatgttctctgtttccagttatatttccagtttacatcatcaaaaagatgatactttttacattttacacaccattgcacctttctcatctggcaccttccttccgaaaatcttcatatacttccttgtcaattttgattggttgttttaaagatgcttttcaatatgcaaataatcagccaaattccagtggcaatagaccatttgaatgtccaaccgaaacacatggtgattaatttaatgattccacatgtaacgatccagctcaggccatagcaggcaatcagtacaacaataaccatagctgcaaccagcccaccttctttaatcttgttttttgtttttctattcatttttttcctcctaaaatgtcaatttataaaaaattgccagtaccggcattccggcttcggcctatgccctaacaacggacctggcttccgtccgcttctggtaacggcgcacccgttgcgctctcttgcgttatcagctctctgctcttttttatttcctatctggtttctactccagagattttttacaaggtttctcgctctccttgccccgttttgcctggataggacagcacaatgtctacaatcgttccgccaattttctaaatctttctgtcagcatacgcacatgcctccaatcaagttccgccccacagtgtggacaatacacgtaatcatccgctactccaaacccgattccttttctcctcagcgtttcccagaatggctcaaaggtaatcatatcctcatcttgtccattgcccgcataattgcctcaaaagcatcatcccagcctctggcataatcgtcctccccatcgcacccggccaatccgactatgacctccttaagcgccctactgtcaatcctgtagcgtcgctcgggcagccgcaaagctctgggcattcccgggtggctggtttccagttccccggaccgtaacaactcacgtacgtattgatgtgccgtagactgtgcacaataagctatatccgcaatctcccgtatagacggtgcgtaatcatactcctgtatgtaatcaacaattacctgttttactgtctccttcgttttcaccgttcatcatctcccacactatcttgtcatagtcatagcagtgttcttccaggttgtgaaagcggttcttgcttttggcggtcgattcctgcctcctgctcccgttggcggtcaattcctgccgctgggtccgtgcccagtttcgcacggctgctttccagtccctcattttgtttttcccgatcatccaatcctttgccgtgtaaaagtcaataaagcgttcagaatcaatgctatattcctgctccaggcagtattcccttacgtcctccagtgtgggaggcgcaaagcgcacagcccctttactctctttatctttctcttttactttatctttctcttttactttctctttttctttaggttccggtttggttactgtctggttatcattcggtttctctttggttactgtttggttatcgcctggttctggttcggtttttggtctgcctcccttggttccgttctgataccgtttattattggcatcaatctgtggctttacgagacaataaatggttttttctatcccggatgtctccggctccttcccgtccagaccatactccataatcgccttaaagcattttgcaagctcggcatccgacaactcctttatggcgttgtaaaaactcctgtaaaaaacaattccgtctcgcatcatccaccgcccattccgccgaacatactaatctgcccaggcactcccttgctcctcgcgcctcctgcaaacctcctggcgcctctctgggacatccggatactcttaatccgcttgtcctgcctggctgcccatcggctcgcctcctgacgcccttccggtgtcgttggcggcagataataaccccggccgtcatcttgcgtgaggataggataatcctgcctcagagcctcaatcgcccgcctcaggctgcgatccccgcaccggagtttttgacacagctcctgtcgggtctgggcgttctcacggccgattcccagggcgttataaacgctatatgtaaatacttcaaattcgttgatgttcctcgcctcccctccggaggatacgggcagcctcggtctgaccgcccgttacgcttaagtggcatcgtatcgtgatatactaacctaaaaagtgcatgaaagttgatagttgctatgtataatccctgcggcattataccttgataaattctccgaagctcccaaagtcttctgtttctactgtctgatatttcttgattccgtacaccttgtaccgctccatgaatcggatatttccaagattgtgggcctgtacatgatgtccccggcatagtgcaataatctcgctatcactatcgtcatagctcctccggtcgtttcccatcccaatcgcatccacatgatggacgtctgcggggcggccacatatacagcatttcttataccggatgcactggattaaatatgcatcgatatcgtccgtacgcttcaggccgctctccgttaggataattccgttgcgcaggcagacatccatcaggaaattgataaactcccttgccgtggtcacagaacagcctgataagctgaaatactggcatcccgtcttttcgatataacagtacttcatccactcttttgtcacttccggcgggtctccggtatagtcgctgatgtctctcagcgtggcatatatcttcttacgctgttcgatggagatatggcggccatcatccagaatcacttctgcgtggcggatattctggcgtttgataaggtatcggatatcctggggaaaatggaccagcaggtcaacaccgtccccggccgcccgataaccggttatatcggtgaagtaattcatgcttctacctcctctttaattccacggcagcccacagtcatcatccggcgggatcgtctcgggatctggttcttttttctgcactttatccggcttctcccgtagctgattcatggcatctttaaattgttccatgttcaaacgggagagctggcctaccttgtagttcgtgcatatgcttctcacgccgattccggttcgcacaagttcgtttagcagcgtgttaatttgtgtttctgtcagtccttcctgtttgcctgtctcctcgataggttccgtttttggcccggaacctatgtggtacaccactttgcacgtcctgacattctgaatttccaggacgtcgattctgccttcgctgtcatatccgatctggctgaccgaaaatttatcgtagcaggtatatgcctcttttccacctgtcttctttgccgttatcttgcagtccttgtctccaatccagataaagggggccgtatataattcccggccaatcccccagttaaaacaggcacgtttaaagctgtcagaggcaagcccctttgccttctctgtatagctttctgttccggtgtcttctttctcaatccactgttgcttgtcatcgtcccagatggatacgatgcagtttgcattctccctgcaatgccgccgctgccagttcatcggcccgaccgtttcatccagtatgttttggtctacgcgggcatccttgtaaagcagtagtgtaataccgttggctctgactgtcgcaatccggcagtcaatttcatctgcctttaggcacctaaatttcagtttctccattttgtaacacctgcactttctctttcgggccaaactccaattcataattcattcccatgcggctgcccttcacattgaccgtgttccccactgttacggcctctttaactgtgcattccgcccagttatcatagtccccatattcaaaacggatgacatctcctgcttttaattcagttgcgcttttaaccatgcttccgcctcctgtaaaatcatttctacctggtttccattgccttcttgtataatcccctgtgttctcctacctctgagtgccttttcccggaccttctgtctgcattcgtcgcagagcaggccttcacccggatccagatagcagccgcacaggtcgcagttataccggatcattcgtcctccttctgagaaagctcaagccccagtatagcggcacaatcttccttgctgactgaatatcgttcgcgattcagccacctttcaaatgctgtaacacgaccttttaattcacaaagttcttgaaacgtttcactcgcaatataaattttgtcactattatccatcttgcatttcctccacttttgctttataatgttggtatgattattttctatgtacctgagcctgtccggttgccgccggcaggttctttttctttctcggagccagtttcccggtgtaaatatttacgccgatggcagccccggcccggttggtgccattccttcgtctgctcatgcttgtcctcctccttacaacatccctgccgtctgtgccactgccagcagcgttccggtcaatactgcgcagataattaacgacacagccagcagcctgtacagccatagtcgttctgcccgttctacccgcagctgacgccgcattcggacgacctgggcaccggtgtaatcatgtttgtgcattggtatcacctcctttacataatggtcttgcgctgttcctctggtacacctaaagcctcgcatagtagccataaatcttccagtttaaaaaggcctggatccatttttcgcttttcaaacgtccttagtggcatatggattgccttcgcgattccggcattggtcatatttctgcgagccttatgttcgctgataattgctcgaacattttctgcctgctgacgggtgtaggcggcatgggcggctgctttttgcttgtctgtcatgttcttacactcctttctcttccttgattttcacagcctcctgacctatactgtaggcgttgcaccgccgagtacataagaaaggagagctatcatgtttaaatcaaccaaagaatttgattccgctatgaaagacatcttggttcaaattcgcgacggtatcgctgttaactctttatcttcttctatagatgaaggtgattttaatgcagctcttgcagagtgcgttgatcggagatatctgagcggcttatcataccagcgcacgatggatggcaaaccacatttttctctgactgatgttcgtgttacttattctggcttgacattcatcgagtctcattaagcaggaatcttattctatgtggactagagtgcttgacaaaaccatatcctttactataccaagcactctttccatatcattaactgtagcatgatgtctttccaacaccttaacaacttccttggcgcacgataaagcctcaaatgctttcttttcttccatcctctctcgcctccttttcccattgacatattgttttactcccatccctgtgatacaatctccttatcagtttgccatgctgaaatacagaagaaaggagactcaccatgaccgataatgaaaaacgtgctcatgattttgcggtttctatcctccctaaaatgtttgaaattcgcgttaacgaagctcaaagtcaggaaaagggaaatgtcactattgatttatacacggaatatctcgatatatataatcgtgtacttgaatcttttaatcgtgattttcttgatgagaaatagtttttcccctgaacttaatatcaattttcttgggctccacagcactccgaatgctctggagctcttttcttatcagaatcagttcctgatagatattcttaaaaatcatccctctctcacactcctttcgctttttttattgacacatttccgatacagtgatatagtcgttttatcgaacatatgttttgctactccaagagtttttcgatattgacttttaaaacctttgcaaccgcctgaagtttatctaccgttggactggcatcattccatttgctgatagcaccattacttaatcctgcctctttttctacagaacgtatgcttatccctttagagttgcaaattgttttgattttatcatatatcatgatcagcctcctttcatgagcaatattagaaaacattctgtatctctattgacaaaatgcagaaaatattctattatgtagttaccaggctaccaataattattaaagcattttaccgaaagttttctgtgttcatactcttattatacagaaatctttctaattgtcaagcgtttttgtagaaaactttcggtaaatttaggaggcgtttctgtgacagtgtttgaacgtattgaaagtttaagaaaaacacataaaatatctcagggtaaattagaaaaagaattaggcttttccaatggatccatttcaaagtggaagataagtatgcctacaacagagcgattacagaaaattgcagattattttgacgtaagcatagattaccttttgacaggaaaagacgaaccaaagatgaaagaagctacactcactccaaaagatgaaagagatattgcaaagattcttgagcaaacgcgagagcagctcctttctcaggagggacttatgttcgatggtgatccggccacccccgaagcaatcgagtctatcctgtcagcaatgcagattggtatggaacttgcgaagaaaaagaataaggagaagtacactccaaaaaagtacaaaaaggactgattttatggatataaaaaaattagctgattctttggcgtggaaacaccgaagcagagacccatttgaagttatccggggattaaacgtaatactgatattcgctccactgattgacgtgagagccttttatcagtattttcagcgaaataatattatttacatagataatagtttatcgcgccacgagcaggcttttgaatgtgctcacgaaatgggccatatgtttatgcataaaaaggctaatatgatatttatggatactaggacttgctttaataccggaaaatttgaggatgaggcagatacatttgggatggattttttaataagcgatgaaacattattagaatattcaggatgttctgtcgaacaattatcgcgtattttgggttatgaagagcgtttaataggattgcgcttaagagcaaacaatttaaaggagtgatcatatgaaatacaaagagtttttagattatctagaaaagaatctttctggctatcaaacatttatgtttaaagccatgcagttccagcgagtcaaaaatgccgagcggcagaaaaaagaccgctgggaagacaaaaagctggaaaaggccgctggcgagatgtggaaaaaagcaatggagacattatataacaatttgaggcgagaactcaaatcagacatagcttcggcctggacctcttacattgaaaaacatgagattttggaatctgtcaacgagagtattaatgagttggatttttatgatgacgcagcatagatataattcttaatcggaggaatttttatgagtataaaaggaactactaaagaactttttgtcggaaaagaagaaattaatcttattacttttatcgggaataagataacaattccttattctgttatgaaaggggttaattattcctatgcgtctcgacttaaaaccggatttctgctatttaaaagaaatgataatactaatatacgctttgattttggatacaacgttaatgaaaaaatcattcagactattaattttattaatgaacatcagccttggcttgaaacaaaagaatttgatattaacgaatttaaaaataatcgttcagcctcattgacgccaatttccggttataaagaattaggattatcatcattaggcttatccatacatcagcggatagatggaaccgtttattttaattcagacacatcaaatatttacaccatctcggcgtatgaatggaacggccctgaatataatacagttactaatgcgtctaccagcgaggtcggaaagagcaccactaaaaagcaaggtaaggccctgaaaatcggagctggtgcacttttaggaagccttgtcgctcctggcgtcggaacacttgtcggtgccgctatgggggcaggaagtaaaggtaaggaaaaaacgaaggggcataaaaccgcaaatctacagcagacagaaaaaaatgtagaaaaaagtacaattgcatttttttcccttgtcaacgttgatacaaaaaagacctataaaatatcctttaaatgcgacagcaagcttgatgccactctaaggtgtttcgatataacaacaccagatacaaaggagtctattgtaatggatacccaaaaatcattggaaggtatcaaggcattaaaggaattactcgatatgggggctatcacacaagaagaatttgaaagtaagaagcagatacttttgaacttataacagcaaaaagccccaggagccgaaaacccctagagcttttcacatagatgctcttgccggatgctaccggaaagataggtttagtttagacacctaaattatatcatccagagtgcgtcctggcaaggggcgtattaattttaccctaaaataggaaaggatgatataatggcaacagcaaaaaaattaccgtcaggctcctggcgctgcctggcctacagccacactgaaaaagtgattgatgaaaagacaggaaaaaccaaaagcaagcgggtctatgaatcctttacatctgatgacccgtcgccacgcggaaagaaagaagcagaggccgcagccgccctattccagcttaacaaggagaaacggccgaagagccatgagtataggaacatgaccctgtcggaggccattgacgcctacatagagagccgggaggctatcaaccggtcgccaaccacaatacaggactaccgctgcatccagaaaaatgccttccaggatatcatggattcgaaattaaaggatctggacgaagaaatcttacaggaagccattaatgtggaagcccggaggccatcaagaaagcgcgccaggaacccgaagccaatatcaccaaaacgtctgaaaaatgagtggggcctggtcacagccgtgctgaacaaatatcaaaaagagctgaactttgaaaaaatcgaactgccacaggtcatggagcgaatagtggaactcccttccgccgccgacgtgctgcgcatcatcaagggaacggacatagagctgccggtactcctagcggcgtggctctctttttccatgtcggaggtccgcggactgacgaaatcaaaatccatcagcgggaattatataactatccgtgaggtagttgtcgatgttggccgagaagcgaaaagaaaggatatgggaaagaatcctgccaggaaccggcgtcatcggataccgccttacatcaagcagcttatcgaccaggtggacggagacatcctggtccctatcagtggccgggccctgtatcaccgatggattaagctacaggatgacaatggcatggcgcatattacttttcacgatcttcgccatctcagcgcgtctgtcatggctttgctgcggatacccgataagtatgcccaagagcgcggcggctggaaatctgacaaggtaatgaaaaaaatctacatgcagactttttcggaggaacgcgaaaaggtggataatatcattgatacgtactttgaaaaaatcgtagaaccggatgacattaatttggatatgagcaagtaccaggcgtggcttaccctatacgataaaacagattgtcgcgagtcaaaaaaggaatttttaaggttcatgcaacacgaaatacaacacgcattaaaaaaagtaccgtagttacggtacttttgagagcgcgagacgggattcgaacccgcgaccctcgccttggcaaggcgatactccaccactgagccactcgcgcatatattagaatcggggtgacaggattcgaacctgcgacctcctggtcccaaaccaggcgctctagccaagctgagccacaccccgtcatccgtttctctatattatcatattcaatttataaatataggtgtgcgggcatttatgctatgcttgctatataacctccggcgcatggttgagttgggtgttgggaagatttcacccttgccaccggcagggcgcacactcaaaccaacggttgagtataagtgcgcccttacggggttgctttgtacttctcatacagaatcttccgtatgtcctcgcccgttatctctccccgcttttccctttcgacaagttccagaaacccgtctgacggcttcaatccgtctaactgcactatgcctatcgcaaagtcccacgctttgtcattatccatgtcatgccccctgttcggttttgggcttccgtccccggctctttggcttcgtctgctccggggcggcttccgtctttttcgccgccctctgcttcggctgtttcacaatatccatggtctgctgtccccggatattctcgttggtgactttcacactccatatccagtctgtaatggcttgagaaacgctcttatggttttcaaaggcatactgttttagccgttcctctgtgtccggcgtgacggagatattaacccttttcttgttcgccactcttaccacttcctttcccgccgtctggctctctttccctctaactgcatacgccgccttgccacaaagtaatagccgttgtctgcttcgattctggacgctacccactccggcgggtcgtcctcgctgtcctgtaccagaatttcaaccgggcttccgcacgtcaattcgattccgtcaaactcatagcgtccgttctggttcatgtgaagcgttccctcgttggctatcggctgatgaatgtagtccatgattctcactacctcgtccagtcgttttaagattctcatgtactccgtcataagctgaacctcgtccgggttgccctcgtcaatctgcaccgattcaagatattcttcgtactcatagcccacgctccgcaaaaggctttttatggtctggttcgtgtccttgattttcgctgtcaattcctctaatctcatggcaattctcctttctgtttatacatacattatacacacgttttacacaaatgtcaagcattattttacacacgttctacacatatcatactcacggtgaggacgaaaaaggggcgcagagcctttcagtcctgcgcccctttttcgtctgttactgccatgtcatttgcagttcccttttgttgttcatgcagtccgacaaatacaggtttataagcgtctggtacggtatgccaaccttttccgcctgtgccttgaaataatcaatgacagacggcgaaatctttatagtgacctgtttttttagttcccttgcatacgggtttttgaccgccttgctgaaatcaaattccctttccagaaattcatctctgtcattcatagtccaatgctcctttcatagcccgctttttcggttgcggtagcctttctcgttgagatgatacggataactgtttcatcacggatacaatgcacgacaaggagtatgctcccgttctcactgcgcccaatgatacggaacctgtcctcgtcctctgaatgtagttcgtcatactctaataacgcctgttcatcatagaacactgtccttgcttcctcgaaagaaacgccgtgtttccgttggtttatctggtttttgttctcgtcccagtcgaatacatacatttccgtccgctcctttagtatttacaaagtaattatactatattcacgttggttttgtcaagtgttgctttacgcacattgtacacactttgtactcaccgtgaggacggaaaaaggaacaaagggcggcacacgccgccgttccgggactgcgagcagataccgggaacggcggcgtgtgccgccctttgacttgattcttagtaacattttgcgagaaaatgaggtggcggcttagtattacccgccaccttgtaacctgtaaccaacattcagaaaatagctatatttcagcgtttttcatggttacaacgtaatgtaaccaatgctgtaaccgttaccctggcttttcacttcgtaaccaaaaatatgccccctccgggcgcacccgcttagagggggctatacagacggtttctgcccgtctataaatataaacgattgtgagtacaaaacgtgacactttctgccggaaagtttgcattttcggcatttttcacaaaaaaaccgctctgcaggggaacggatgcaccccgtccgggcggcttttctttgttcactatgacgaaatttgtctttcggtgtaatattctgccgtttcatgtcatgtactgtataggagcggtaaaaaggaaaatctggtagggcgggtgtgaagctgatacccttgacctctcaaaacgcccttattcgccctctggacggcttttaggggctgtatggtatatttcccttacctaccccttaaaagctgtgtacacgccttagaatcgcttccagagcctactttcttttcactgtctaccccttaccctctgacgttcccagaacttcccggaaaaggctgtaaccgcccctctttttttctttttattgctaatgccctttgactgtcaaacggtgtcgaatcatgcggctgaaacggcaaatttccccctcgcccccccccccgtttttccgcgcgcgcgtaggagagagatatttattgattatttaaggactatttaattatttaggagagagcaaaaccccagaacccttgcggtttccggggttttttctgtgacttttggtacggttattgtgacttttggtacggactaatgtgacttttggtacggactaatgtgacttttggtacggtggaaaactttttattgtgacttaactattgacaggtcacaataaagatgctataatgaatttatacataaaacgtgtgtataaaatacgccgtactaacggtcacaataaggggtgtgttgtcgaatggacgaatacgaaagagaagcgttagacaagcagaggtattatcatgtggtcaagggtaatgaattggtgcagaaaagccgctatgagctgtccttgccggagcaaaagacgatagcctatatatgctccatgattaagcctgtggacgtgacagacagtgtacagggcgtcccgtaccaactggaatatgagttcaatatccgggagtattgcaaggtctgcggcttcgactatgacaacggcaagaactacgccgatataaaggcaactttgaagcacctgcgggacaagtccatgtggctgactatggagaacgggtctgaaacccttgtaggttggctttcacgggtcacggtaaataagcagagcggcatagtcaagataaaacttgacgatattcttgtcccgttcctgttcgatttggggcagaggttcacggagtacaggcttattcaaatactgggaatgaagtccgcctactctgtgcggatatacgaactgctgaagtcctacgcctaccagaagtcaaagacctttggactggacgaactgaagcggttgctcatggtggacgggatagaatcatacaaccgcttcccggacttccggcgcaaggttctggagatagccgtcaaggagataaacaagctgacggacttgaacgtgtcctatgaagctatcaagaaagggcgcaaggtggacaagctgaaattccgcatagaaacaaaagagagtatcccgcagcttttcgcacgtctggaaacggggaagattctggacgagaagcagaagtgatggcacaaggcagagaaaggggcttgtatgcaagaattttctaacaaggaacttgaatatttgaagctaatagaaaaagcattttcccgccgtctggcaaggagcgaaacggcaaaagtctgttattgggttgcccaaaatatccccctatccgaaattatccgggcttttgaaattatggttacgaaagttagcagtctttcatttccgtacatggcggcaatcgttgaccgttggcaggagcagaaaaacggaaacggaaaaacactcatggagcaagccgccgaaattgatgagcggtacgggagtgaaaagtgagtggaacactctcaccctttttccggcttgattgcccaccaacggaacggagagaatcagtcaagggcaacgaaatttttcacccggttacgcttccggcttccggctcggcgtgaccgggtgaaaaatttttcggagcgtagcggagaacccttgacggattctcggagtggagtacaatcgggcaagccggaaaagggggaagctgcgccgcacgttcccctcaaaatccccctgcgtcccagggagattttgcgccgggggtcttaggggtttcccctaacaagcgcataaatgtatgtacaccgttttacggtgtgcgggcatttatgctatgcttgctatataacctccggcgcatggttgagttgggtgttgggaagatttcacccttgccaccggcagggcgcacactcaaaccaacggttgagtataagtgcgcccttacggggttgctttgtacttctcatacagaatcttccgtatgtcctcgcccgttatctctccccgcttttccctttcgacaagttccagaaacccgtctgacggcttcaatccgtctaactgcactatgcctatcgcaaagtcccacgctttgtcattatccatgtcatgccccctgttcggttttgggcttccgtccccggctctttggcttcgtctgctccggggcggcttccgtctttttcgccgccctctgcttcggctgtttcacaatatccatggtctgctgtccccggatattctcgttggtgactttcacactccatatccagtctgtaatggcttgagaaacgctcttatggttttcaaaggcatactgttttagccgttcctctgtgtccggcgtgacggagatattaacccttttcttgttcgccactcttaccacttcctttcccgccgtctggctctctttccctctaactgcatacgccgccttgccacaaagtaatagccgttgtctgcttcgattctggacgctacccactccggcgggtcgtcctcgctgtcctgtaccagaatttcaaccgggcttccgcacgtcaattcgattccgtcaaactcatagcgtccgttctggttcatgtgaagcgttccctcgttggctatcggctgatgaatgtagtccatgattctcactacctcgtccagtcgttttaagattctcatgtactccgtcataagctgaacctcgtccgggttgccctcgtcaatctgcaccgattcaagatattcttcgtactcatagcccacgctccgcaaaaggctttttatggtctggttcgtgtccttgattttcgctgtcaattcctctaatctcatggcaattctcctttctgtttatacatacattatacacacgttttacacaaatgtcaagcattattttacacacgttctacacatatcatactcacggtgaggacgaaaaaggggcgcagagcctttcagtcctgcgcccctttttcgtctgttactgccatgtcatttgcagttcccttttgttgttcatgcagtccgacaaatacaggtttataagcgtctggtacggtatgccaaccttttccgcctgtgccttgaaataatcaatgacagacggcgaaatctttatagtgacctgtttttttagttcccttgcatacgggtttttgaccgccttgctgaaatcaaattccctttccagaaattcatctctgtcattcatagtccaatgctcctttcatagcccgctttttcggttgcggtagcctttctcgttgagatgatacggataactgtttcatcacggatacaatgcacgacaaggagtatgctcccgttctcactgcgcccaatgatacggaacctgtcctcgtcctctgaatgtagttcgtcatactctaataacgcctgttcatcatagaacactgtccttgcttcctcgaaagaaacgccgtgtttccgttggtttatctggtttttgttctcgtcccagtcgaatacatacatttccgtccgctcctttagtatttacaaagtaattatactatattcacgttggttttgtcaagtgttgctttacgcacattgtacacactttgtactcaccgtgaggacggaaaaaggaacaaagggcggcacacgccgccgttccgggactgcgagcagataccgggaacggcggcgtgtgccgccctttgacttgattcttagtaacattttgcgagaaaatgaggtggcggcttagtattacccgccaccttgtaacctgtaaccaacattcagaaaatagctatatttcagcgtttttcatggttacaacgtaatgtaaccaatgctgtaaccgttaccctggcttttcacttcgtaaccaaaaatatgccccctccgggcgcacccgcttagagggggctatacagacggtttctgcccgtctataaatataaacgattgtgagtacaaaacgtgacactttctgccggaaggtgctgaagcgttgaaacctttgtcctctcttaccagtatgtcaaactggaaattgtaggcgtcaaa

SEQ ID NO: 17 - skipped
